United States Patent 11,739,335 (NUCLEIC ACIDS ENCODING CRISPR-ASSOCIATED PROTEINS AND USES THEREOF) - sequence listing, part 14

SEQ ID NO: 10441 - RNA, 4116 nt, Artificial Sequence
  Cpf1 variant mRNA product
gggagaggcgcugccuacggagguggcagccaucuccuucucggcaucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10442 - RNA, 4116 nt, Artificial Sequence
  Cpf1 variant mRNA product
gggagaggcgcugccuacggagguggcagccaucuccuucucggcaucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10443 - RNA, 4116 nt, Artificial Sequence
  Cpf1 variant mRNA product
gggagaggcgcugccuacggagguggcagccaucuccuucucggcaucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10444 - RNA, 4168 nt, Artificial Sequence
  Cpf1 variant mRNA product
ggggcgcugccuacggagguggcagccaucuccuucucggcaucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10445 - RNA, 4168 nt, Artificial Sequence
  Cpf1 variant mRNA product
ggggcgcugccuacggagguggcagccaucuccuucucggcaucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10446 - RNA, 4168 nt, Artificial Sequence
  Cpf1 variant mRNA product
ggggcgcugccuacggagguggcagccaucuccuucucggcaucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10447 - RNA, 4168 nt, Artificial Sequence
  Cpf1 variant mRNA product
ggggcgcugccuacggagguggcagccaucuccuucucggcaucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10448 - RNA, 4168 nt, Artificial Sequence
  Cpf1 variant mRNA product
ggggcgcugccuacggagguggcagccaucuccuucucggcaucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10449 - RNA, 4168 nt, Artificial Sequence
  Cpf1 variant mRNA product
ggggcgcugccuacggagguggcagccaucuccuucucggcaucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10450 - RNA, 4168 nt, Artificial Sequence
  Cpf1 variant mRNA product
ggggcgcugccuacggagguggcagccaucuccuucucggcaucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10451 - RNA, 4070 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10452 - RNA, 4070 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10453 - RNA, 4070 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10454 - RNA, 4070 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10455 - RNA, 4070 nt, Artificial Sequence
  Cpf1 variant mRNA product
gggagagucccgcagucggcguccagcggcucugcuuguucgugugugugucguugcaggccuuauucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10456 - RNA, 4070 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10457 - RNA, 4070 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10458 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10459 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10460 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10461 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10462 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10463 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10464 - RNA, 4167 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10465 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10466 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10467 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10468 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10469 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10470 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10471 - RNA, 4103 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10472 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10473 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10474 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10475 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10476 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10477 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10478 - RNA, 4052 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10479 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10480 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10481 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10482 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10483 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10484 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10485 - RNA, 4038 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10486 - RNA, 4019 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10487 - RNA, 4019 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10488 - RNA, 4019 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10489 - RNA, 4019 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10490 - RNA, 4019 nt, Artificial Sequence
  Cpf1 variant mRNA product
gggagagucccgcagucggcguccagcggcucugcuuguucgugugugugucguugcaggccuuauucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10491 - RNA, 4019 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10492 - RNA, 4019 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10493 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10494 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10495 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10496 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10497 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10498 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10499 - RNA, 4315 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10500 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10501 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10502 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10503 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10504 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10505 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10506 - RNA, 4105 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10507 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10508 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10509 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10510 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10511 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10512 - RNA, 4321 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10513 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10514 - RNA, 4101 nt, Artificial Sequence; identical to SEQ ID NO: 10513
  Cpf1 variant mRNA product

SEQ ID NO: 10515 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10516 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10517 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10518 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10519 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10520 - RNA, 4101 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10521 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10522 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10523 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10524 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10525 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10526 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10527 - RNA, 4128 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10528 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10529 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10530 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10531 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10532 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10533 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10534 - RNA, 4324 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10535 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10536 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10537 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10538 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10539 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10540 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10541 - RNA, 4059 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10542 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10543 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10544 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10545 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10546 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10547 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10548 - RNA, 4179 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10549 - RNA, 4441 nt, Artificial Sequence
  Cpf1 variant mRNA product
ggggcgcugccuacggagguggcagccaucuccuucucggcaucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10550 - RNA, 4204 nt, Artificial Sequence; identical to SEQ ID NO: 10394
  Cpf1 variant mRNA product

SEQ ID NO: 10551 - RNA, 48 nt, Artificial Sequence
  NLS3 variant
aaaaggccggcggccacgaaaaaggccggccaggcaaaaaagaaaaag

SEQ ID NO: 10552 - RNA, 3924 nt, Artificial Sequence
  Cpf1 variant
augacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacuga

SEQ ID NO: 10553 - RNA, 3972 nt, Artificial Sequence
  Cpf1 variant
augacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaaguga

SEQ ID NO: 10554 - RNA, 4488 nt, Artificial Sequence
  Cpf1 variant mRNA product
gggagagucccgcagucggcguccagcggcucugcuuguucgugugugugucguugcaggccuuauucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10555 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10556 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10557 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10558 - RNA, 4192 nt, Artificial Sequence
  Cpf1 variant mRNA product
gggagagucccgcagucggcguccagcggcucugcuuguucgugugugugucguugcaggccuuauucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10559 - RNA, 4302 nt, Artificial Sequence
  Cpf1 variant mRNA product
gggagaggcgcugccuacggagguggcagccaucuccuucucggcaucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10560 - RNA, 4354 nt, Artificial Sequence
  Cpf1 variant mRNA product
ggggcgcugccuacggagguggcagccaucuccuucucggcaucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10561 - RNA, 4257 nt, Artificial Sequence
  Cpf1 variant mRNA product
gggagagucccgcagucggcguccagcggcucugcuuguucgugugugugucguugcaggccuuauucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaaguugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10562 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10563 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10564 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10565 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10566 - RNA, 4205 nt, Artificial Sequence
  Cpf1 variant mRNA product
gggagagucccgcagucggcguccagcggcucugcuuguucgugugugugucguugcaggccuuauucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10567 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10568 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10569 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10570 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10571 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10572 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10573 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10574 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10575 - protein, 16 aa, Artificial Sequence
  NLS3
KRPAATKKAGQAKKKK

SEQ ID NO: 10576 - protein, 1323 aa, Artificial Sequence
  Cpf1 variant protein
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKK

SEQ ID NO: 10577 - protein, 1316 aa, Artificial Sequence
  Cpf1 variant protein
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKK

SEQ ID NO: 10578 - RNA, 48 nt, Artificial Sequence; identical to SEQ ID NO: 1379
  NLS3 variant

SEQ ID NO: 10579 - RNA, 3972 nt, Artificial Sequence
  Cpf1 variant
augacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaaguga

SEQ ID NO: 10580 - RNA, 3951 nt, Artificial Sequence
  Cpf1 variant
augagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaaguga

SEQ ID NO: 10581 - RNA, 48 nt, Artificial Sequence; identical to SEQ ID NO: 2539
  NLS3 variant

SEQ ID NO: 10582 - RNA, 3972 nt, Artificial Sequence
  Cpf1 variant
augacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaauga

SEQ ID NO: 10583 - RNA, 3951 nt, Artificial Sequence
  Cpf1 variant
augagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaaguga

SEQ ID NO: 10584 - RNA, 48 nt, Artificial Sequence; identical to SEQ ID NO: 3699
  NLS3 variant

SEQ ID NO: 10585 - RNA, 3972 nt, Artificial Sequence
  Cpf1 variant
augacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaauga

SEQ ID NO: 10586 - RNA, 3951 nt, Artificial Sequence
  Cpf1 variant
augagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaaguga

SEQ ID NO: 10587 - RNA, 48 nt, Artificial Sequence; identical to SEQ ID NO: 4859
  NLS3 variant

SEQ ID NO: 10588 - RNA, 3972 nt, Artificial Sequence
  Cpf1 variant
augacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaa

SEQ ID NO: 10589 - RNA, 3951 nt, Artificial Sequence
  Cpf1 variant
augucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaa

SEQ ID NO: 10590 - RNA, 48 nt, Artificial Sequence; identical to SEQ ID NO: 6019
  NLS3 variant

SEQ ID NO: 10591 - RNA, 3972 nt, Artificial Sequence
  Cpf1 variant
augacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaa

SEQ ID NO: 10592 - RNA, 3951 nt, Artificial Sequence
  Cpf1 variant
augucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaa

SEQ ID NO: 10593 - RNA, 48 nt, Artificial Sequence
  NLS3 variant
aaacgcccggccgcaaccaaaaaagcaggccaggccaaaaaaaaaaaa

SEQ ID NO: 10594 - RNA, 3972 nt, Artificial Sequence
  Cpf1 variant
augacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaaguga

SEQ ID NO: 10595 - RNA, 3951 nt, Artificial Sequence; identical to SEQ ID NO: 10580
  Cpf1 variant

SEQ ID NO: 10596 - RNA, 48 nt, Artificial Sequence; identical to SEQ ID NO: 4859
  NLS3 variant

SEQ ID NO: 10597 - RNA, 3972 nt, Artificial Sequence
  Cpf1 variant
augacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaauga

SEQ ID NO: 10598 - RNA, 3951 nt, Artificial Sequence
  Cpf1 variant
augucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauag

SEQ ID NO: 10599 - RNA, 4488 nt, Artificial Sequence
  Cpf1 variant mRNA product
gggagagucccgcagucggcguccagcggcucugcuuguucgugugugugucguugcaggccuuauucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10600 - RNA, 4467 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10601 - RNA, 4488 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10602 - RNA, 4467 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10603 - RNA, 4488 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10604 - RNA, 4467 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10605 - RNA, 4488 nt, Artificial Sequence
  Cpf1 variant mRNA product
gggagagucccgcagucggcguccagcggcucugcuuguucgugugugugucguugcaggccuuauucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10606 - RNA, 4467 nt, Artificial Sequence
  Cpf1 variant mRNA product
gggagagucccgcagucggcguccagcggcucugcuuguucgugugugugucguugcaggccuuauucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10607 - RNA, 4488 nt, Artificial Sequence
  Cpf1 variant mRNA product
gggagagucccgcagucggcguccagcggcucugcuuguucgugugugugucguugcaggccuuauucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10608 - RNA, 4467 nt, Artificial Sequence
  Cpf1 variant mRNA product
gggagagucccgcagucggcguccagcggcucugcuuguucgugugugugucguugcaggccuuauucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10609 - RNA, 4488 nt, Artificial Sequence
  Cpf1 variant mRNA product
gggagagucccgcagucggcguccagcggcucugcuuguucgugugugugucguugcaggccuuauucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10610 - RNA, 4467 nt, Artificial Sequence; identical to SEQ ID NO: 10600
  Cpf1 variant mRNA product

SEQ ID NO: 10611 - RNA, 4488 nt, Artificial Sequence
  Cpf1 variant mRNA product
gggagagucccgcagucggcguccagcggcucugcuuguucgugugugugucguugcaggccuuauucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10612 - RNA, 4467 nt, Artificial Sequence
  Cpf1 variant mRNA product
gggagagucccgcagucggcguccagcggcucugcuuguucgugugugugucguugcaggccuuauucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10613 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10614 - RNA, 4564 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10615 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10616 - RNA, 4564 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10617 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10618 - RNA, 4564 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10619 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10620 - RNA, 4564 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10621 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10622 - RNA, 4564 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10623 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10624 - RNA, 4564 nt, Artificial Sequence; identical to SEQ ID NO: 10614
  Cpf1 variant mRNA product

SEQ ID NO: 10625 - RNA, 4585 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10626 - RNA, 4564 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10627 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10628 - RNA, 4248 nt, Artificial Sequence
  Cpf1 variant mRNA product
gggagagcggcucggccauuuugucccagucaguccggaggcugcggcugcagaaguaccgccugcggaguaacugcaaagaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10629 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10630 - RNA, 4248 nt, Artificial Sequence
  Cpf1 variant mRNA product
gggagagcggcucggccauuuugucccagucaguccggaggcugcggcugcagaaguaccgccugcggaguaacugcaaagaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10631 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10632 - RNA, 4248 nt, Artificial Sequence
  Cpf1 variant mRNA product
gggagagcggcucggccauuuugucccagucaguccggaggcugcggcugcagaaguaccgccugcggaguaacugcaaagaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10633 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10634 - RNA, 4248 nt, Artificial Sequence
  Cpf1 variant mRNA product
gggagagcggcucggccauuuugucccagucaguccggaggcugcggcugcagaaguaccgccugcggaguaacugcaaagaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10635 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10636 - RNA, 4248 nt, Artificial Sequence
  Cpf1 variant mRNA product
gggagagcggcucggccauuuugucccagucaguccggaggcugcggcugcagaaguaccgccugcggaguaacugcaaagaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10637 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10638 - RNA, 4248 nt, Artificial Sequence; identical to SEQ ID NO: 10628
  Cpf1 variant mRNA product

SEQ ID NO: 10639 - RNA, 4269 nt, Artificial Sequence
  Cpf1 variant mRNA product
gggagagcggcucggccauuuugucccagucaguccggaggcugcggcugcagaaguaccgccugcggaguaacugcaaagaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10640 - RNA, 4248 nt, Artificial Sequence
  Cpf1 variant mRNA product
gggagagcggcucggccauuuugucccagucaguccggaggcugcggcugcagaaguaccgccugcggaguaacugcaaagaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10641 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10642 - RNA, 4190 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10643 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10644 - RNA, 4190 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10645 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10646 - RNA, 4190 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10647 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10648 - RNA, 4190 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10649 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10650 - RNA, 4190 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10651 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10652 - RNA, 4190 nt, Artificial Sequence; identical to SEQ ID NO: 10642
  Cpf1 variant mRNA product

SEQ ID NO: 10653 - RNA, 4211 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10654 - RNA, 4190 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10655 - RNA, 4192 nt, Artificial Sequence
  Cpf1 variant mRNA product
gggagagucccgcagucggcguccagcggcucugcuuguucgugugugugucguugcaggccuuauucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10656 - RNA, 4171 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10657 - RNA, 4192 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10658 - RNA, 4171 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10659 - RNA, 4192 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10660 - RNA, 4171 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10661 - RNA, 4192 nt, Artificial Sequence
  Cpf1 variant mRNA product
gggagagucccgcagucggcguccagcggcucugcuuguucgugugugugucguugcaggccuuauucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10662 - RNA, 4171 nt, Artificial Sequence
  Cpf1 variant mRNA product
gggagagucccgcagucggcguccagcggcucugcuuguucgugugugugucguugcaggccuuauucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10663 - RNA, 4192 nt, Artificial Sequence
  Cpf1 variant mRNA product
gggagagucccgcagucggcguccagcggcucugcuuguucgugugugugucguugcaggccuuauucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10664 - RNA, 4171 nt, Artificial Sequence
  Cpf1 variant mRNA product
gggagagucccgcagucggcguccagcggcucugcuuguucgugugugugucguugcaggccuuauucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10665 - RNA, 4192 nt, Artificial Sequence
  Cpf1 variant mRNA product
gggagagucccgcagucggcguccagcggcucugcuuguucgugugugugucguugcaggccuuauucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10666 - RNA, 4171 nt, Artificial Sequence; identical to SEQ ID NO: 10656
  Cpf1 variant mRNA product

SEQ ID NO: 10667 - RNA, 4192 nt, Artificial Sequence
  Cpf1 variant mRNA product
gggagagucccgcagucggcguccagcggcucugcuuguucgugugugugucguugcaggccuuauucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10668 - RNA, 4171 nt, Artificial Sequence
  Cpf1 variant mRNA product
gggagagucccgcagucggcguccagcggcucugcuuguucgugugugugucguugcaggccuuauucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10669 - RNA, 4302 nt, Artificial Sequence
  Cpf1 variant mRNA product
gggagaggcgcugccuacggagguggcagccaucuccuucucggcaucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10670 - RNA, 4281 nt, Artificial Sequence
  Cpf1 variant mRNA product
gggagaggcgcugccuacggagguggcagccaucuccuucucggcaucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10671 - RNA, 4302 nt, Artificial Sequence
  Cpf1 variant mRNA product
gggagaggcgcugccuacggagguggcagccaucuccuucucggcaucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10672 - RNA, 4281 nt, Artificial Sequence
  Cpf1 variant mRNA product
gggagaggcgcugccuacggagguggcagccaucuccuucucggcaucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10673 - RNA, 4302 nt, Artificial Sequence
  Cpf1 variant mRNA product
gggagaggcgcugccuacggagguggcagccaucuccuucucggcaucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10674 - RNA, 4281 nt, Artificial Sequence
  Cpf1 variant mRNA product
gggagaggcgcugccuacggagguggcagccaucuccuucucggcaucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10675 - RNA, 4302 nt, Artificial Sequence
  Cpf1 variant mRNA product
gggagaggcgcugccuacggagguggcagccaucuccuucucggcaucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10676 - RNA, 4281 nt, Artificial Sequence
  Cpf1 variant mRNA product
gggagaggcgcugccuacggagguggcagccaucuccuucucggcaucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10677 - RNA, 4302 nt, Artificial Sequence
  Cpf1 variant mRNA product
gggagaggcgcugccuacggagguggcagccaucuccuucucggcaucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10678 - RNA, 4281 nt, Artificial Sequence
  Cpf1 variant mRNA product
gggagaggcgcugccuacggagguggcagccaucuccuucucggcaucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10679 - RNA, 4302 nt, Artificial Sequence
  Cpf1 variant mRNA product
gggagaggcgcugccuacggagguggcagccaucuccuucucggcaucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10680 - RNA, 4281 nt, Artificial Sequence; identical to SEQ ID NO: 10670
  Cpf1 variant mRNA product

SEQ ID NO: 10681 - RNA, 4302 nt, Artificial Sequence
  Cpf1 variant mRNA product
gggagaggcgcugccuacggagguggcagccaucuccuucucggcaucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10682 - RNA, 4281 nt, Artificial Sequence
  Cpf1 variant mRNA product
gggagaggcgcugccuacggagguggcagccaucuccuucucggcaucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10683 - RNA, 4354 nt, Artificial Sequence
  Cpf1 variant mRNA product
ggggcgcugccuacggagguggcagccaucuccuucucggcaucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10684 - RNA, 4333 nt, Artificial Sequence
  Cpf1 variant mRNA product
ggggcgcugccuacggagguggcagccaucuccuucucggcaucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10685 - RNA, 4354 nt, Artificial Sequence
  Cpf1 variant mRNA product
ggggcgcugccuacggagguggcagccaucuccuucucggcaucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10686 - RNA, 4333 nt, Artificial Sequence
  Cpf1 variant mRNA product
ggggcgcugccuacggagguggcagccaucuccuucucggcaucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10687 - RNA, 4354 nt, Artificial Sequence
  Cpf1 variant mRNA product
ggggcgcugccuacggagguggcagccaucuccuucucggcaucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10688 - RNA, 4333 nt, Artificial Sequence
  Cpf1 variant mRNA product
ggggcgcugccuacggagguggcagccaucuccuucucggcaucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10689 - RNA, 4354 nt, Artificial Sequence
  Cpf1 variant mRNA product
ggggcgcugccuacggagguggcagccaucuccuucucggcaucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10690 - RNA, 4333 nt, Artificial Sequence
  Cpf1 variant mRNA product
ggggcgcugccuacggagguggcagccaucuccuucucggcaucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10691 - RNA, 4354 nt, Artificial Sequence
  Cpf1 variant mRNA product
ggggcgcugccuacggagguggcagccaucuccuucucggcaucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10692 - RNA, 4333 nt, Artificial Sequence
  Cpf1 variant mRNA product
ggggcgcugccuacggagguggcagccaucuccuucucggcaucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10693 - RNA, 4354 nt, Artificial Sequence
  Cpf1 variant mRNA product
ggggcgcugccuacggagguggcagccaucuccuucucggcaucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10694 - RNA, 4333 nt, Artificial Sequence; identical to SEQ ID NO: 10684
  Cpf1 variant mRNA product

SEQ ID NO: 10695 - RNA, 4354 nt, Artificial Sequence
  Cpf1 variant mRNA product
ggggcgcugccuacggagguggcagccaucuccuucucggcaucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10696 - RNA, 4333 nt, Artificial Sequence
  Cpf1 variant mRNA product
ggggcgcugccuacggagguggcagccaucuccuucucggcaucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10697 - RNA, 4256 nt, Artificial Sequence
  Cpf1 variant mRNA product
gggagagucccgcagucggcguccagcggcucugcuuguucgugugugugucguugcaggccuuauucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10698 - RNA, 4235 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10699 - RNA, 4256 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10700 - RNA, 4235 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10701 - RNA, 4256 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10702 - RNA, 4235 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10703 - RNA, 4256 nt, Artificial Sequence
  Cpf1 variant mRNA product
gggagagucccgcagucggcguccagcggcucugcuuguucgugugugugucguugcaggccuuauucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10704 - RNA, 4235 nt, Artificial Sequence
  Cpf1 variant mRNA product
gggagagucccgcagucggcguccagcggcucugcuuguucgugugugugucguugcaggccuuauucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10705 - RNA, 4256 nt, Artificial Sequence
  Cpf1 variant mRNA product
gggagagucccgcagucggcguccagcggcucugcuuguucgugugugugucguugcaggccuuauucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10706 - RNA, 4235 nt, Artificial Sequence
  Cpf1 variant mRNA product
gggagagucccgcagucggcguccagcggcucugcuuguucgugugugugucguugcaggccuuauucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10707 - RNA, 4256 nt, Artificial Sequence
  Cpf1 variant mRNA product
gggagagucccgcagucggcguccagcggcucugcuuguucgugugugugucguugcaggccuuauucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10708 - RNA, 4235 nt, Artificial Sequence; identical to SEQ ID NO: 10698
  Cpf1 variant mRNA product

SEQ ID NO: 10709 - RNA, 4256 nt, Artificial Sequence
  Cpf1 variant mRNA product
gggagagucccgcagucggcguccagcggcucugcuuguucgugugugugucguugcaggccuuauucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10710 - RNA, 4235 nt, Artificial Sequence
  Cpf1 variant mRNA product
gggagagucccgcagucggcguccagcggcucugcuuguucgugugugugucguugcaggccuuauucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10711 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10712 - RNA, 4332 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10713 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10714 - RNA, 4332 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10715 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10716 - RNA, 4332 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10717 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10718 - RNA, 4332 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10719 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10720 - RNA, 4332 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10721 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10722 - RNA, 4332 nt, Artificial Sequence; identical to SEQ ID NO: 10712
  Cpf1 variant mRNA product

SEQ ID NO: 10723 - RNA, 4353 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10724 - RNA, 4332 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10725 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10726 - RNA, 4268 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10727 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10728 - RNA, 4268 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10729 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10730 - RNA, 4268 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10731 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10732 - RNA, 4268 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10733 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10734 - RNA, 4268 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10735 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10736 - RNA, 4268 nt, Artificial Sequence; identical to SEQ ID NO: 10726
  Cpf1 variant mRNA product

SEQ ID NO: 10737 - RNA, 4289 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10738 - RNA, 4268 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10739 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10740 - RNA, 4217 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10741 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10742 - RNA, 4217 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10743 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10744 - RNA, 4217 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10745 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10746 - RNA, 4217 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10747 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10748 - RNA, 4217 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10749 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10750 - RNA, 4217 nt, Artificial Sequence; identical to SEQ ID NO: 10740
  Cpf1 variant mRNA product

SEQ ID NO: 10751 - RNA, 4238 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10752 - RNA, 4217 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10753 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10754 - RNA, 4203 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10755 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10756 - RNA, 4203 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10757 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10758 - RNA, 4203 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10759 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10760 - RNA, 4203 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10761 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10762 - RNA, 4203 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10763 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10764 - RNA, 4203 nt, Artificial Sequence; identical to SEQ ID NO: 10754
  Cpf1 variant mRNA product

SEQ ID NO: 10765 - RNA, 4224 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10766 - RNA, 4203 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10767 - RNA, 4205 nt, Artificial Sequence
  Cpf1 variant mRNA product
gggagagucccgcagucggcguccagcggcucugcuuguucgugugugugucguugcaggccuuauucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10768 - RNA, 4184 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10769 - RNA, 4205 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10770 - RNA, 4184 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10771 - RNA, 4205 nt, Artificial Sequence
  Cpf1 variant mRNA product
gggagagucccgcagucggcguccagcggcucugcuuguucgugugugugucguugcaggccuuauucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10772 - RNA, 4184 nt, Artificial Sequence
  Cpf1 variant mRNA product
gggagagucccgcagucggcguccagcggcucugcuuguucgugugugugucguugcaggccuuauucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10773 - RNA, 4205 nt, Artificial Sequence
  Cpf1 variant mRNA product
gggagagucccgcagucggcguccagcggcucugcuuguucgugugugugucguugcaggccuuauucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10774 - RNA, 4184 nt, Artificial Sequence
  Cpf1 variant mRNA product
gggagagucccgcagucggcguccagcggcucugcuuguucgugugugugucguugcaggccuuauucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10775 - RNA, 4205 nt, Artificial Sequence
  Cpf1 variant mRNA product
gggagagucccgcagucggcguccagcggcucugcuuguucgugugugugucguugcaggccuuauucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10776 - RNA, 4184 nt, Artificial Sequence
  Cpf1 variant mRNA product
gggagagucccgcagucggcguccagcggcucugcuuguucgugugugugucguugcaggccuuauucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10777 - RNA, 4205 nt, Artificial Sequence
  Cpf1 variant mRNA product
gggagagucccgcagucggcguccagcggcucugcuuguucgugugugugucguugcaggccuuauucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10778 - RNA, 4184 nt, Artificial Sequence; identical to SEQ ID NO: 10768
  Cpf1 variant mRNA product

SEQ ID NO: 10779 - RNA, 4205 nt, Artificial Sequence
  Cpf1 variant mRNA product
gggagagucccgcagucggcguccagcggcucugcuuguucgugugugugucguugcaggccuuauucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10780 - RNA, 4184 nt, Artificial Sequence
  Cpf1 variant mRNA product
gggagagucccgcagucggcguccagcggcucugcuuguucgugugugugucguugcaggccuuauucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10781 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10782 - RNA, 4480 nt, Artificial Sequence
  Cpf1 variant mRNA product
gggagagcggcucggccauuuugucccagucaguccggaggcugcggcugcagaaguaccgccugcggaguaacugcaaagaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10783 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10784 - RNA, 4480 nt, Artificial Sequence
  Cpf1 variant mRNA product
gggagagcggcucggccauuuugucccagucaguccggaggcugcggcugcagaaguaccgccugcggaguaacugcaaagaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10785 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10786 - RNA, 4480 nt, Artificial Sequence
  Cpf1 variant mRNA product
gggagagcggcucggccauuuugucccagucaguccggaggcugcggcugcagaaguaccgccugcggaguaacugcaaagaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10787 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10788 - RNA, 4480 nt, Artificial Sequence
  Cpf1 variant mRNA product
gggagagcggcucggccauuuugucccagucaguccggaggcugcggcugcagaaguaccgccugcggaguaacugcaaagaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10789 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10790 - RNA, 4480 nt, Artificial Sequence
  Cpf1 variant mRNA product
gggagagcggcucggccauuuugucccagucaguccggaggcugcggcugcagaaguaccgccugcggaguaacugcaaagaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10791 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10792 - RNA, 4480 nt, Artificial Sequence; identical to SEQ ID NO: 10782
  Cpf1 variant mRNA product

SEQ ID NO: 10793 - RNA, 4501 nt, Artificial Sequence
  Cpf1 variant mRNA product
gggagagcggcucggccauuuugucccagucaguccggaggcugcggcugcagaaguaccgccugcggaguaacugcaaagaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10794 - RNA, 4480 nt, Artificial Sequence
  Cpf1 variant mRNA product
gggagagcggcucggccauuuugucccagucaguccggaggcugcggcugcagaaguaccgccugcggaguaacugcaaagaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10795 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10796 - RNA, 4270 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10797 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10798 - RNA, 4270 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10799 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10800 - RNA, 4270 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10801 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10802 - RNA, 4270 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10803 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10804 - RNA, 4270 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10805 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10806 - RNA, 4270 nt, Artificial Sequence; identical to SEQ ID NO: 10796
  Cpf1 variant mRNA product

SEQ ID NO: 10807 - RNA, 4291 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10808 - RNA, 4270 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 10809 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10810 - RNA, 4486 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10811 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10812 - RNA, 4486 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10813 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10814 - RNA, 4486 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10815 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10816 - RNA, 4486 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10817 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10818 - RNA, 4486 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10819 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10820 - RNA, 4486 nt, Artificial Sequence; identical to SEQ ID NO: 10810
  Cpf1 variant mRNA product

SEQ ID NO: 10821 - RNA, 4507 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10822 - RNA, 4486 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10823 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10824 - RNA, 4266 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10825 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10826 - RNA, 4266 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10827 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10828 - RNA, 4266 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10829 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10830 - RNA, 4266 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10831 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10832 - RNA, 4266 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10833 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10834 - RNA, 4266 nt, Artificial Sequence; identical to SEQ ID NO: 10824
  Cpf1 variant mRNA product

SEQ ID NO: 10835 - RNA, 4287 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10836 - RNA, 4266 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10837 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10838 - RNA, 4293 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10839 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10840 - RNA, 4293 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10841 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10842 - RNA, 4293 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10843 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10844 - RNA, 4293 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10845 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10846 - RNA, 4293 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10847 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10848 - RNA, 4293 nt, Artificial Sequence; identical to SEQ ID NO: 10838
  Cpf1 variant mRNA product

SEQ ID NO: 10849 - RNA, 4314 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10850 - RNA, 4293 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10851 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10852 - RNA, 4489 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10853 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10854 - RNA, 4489 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10855 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10856 - RNA, 4489 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10857 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10858 - RNA, 4489 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10859 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10860 - RNA, 4489 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10861 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10862 - RNA, 4489 nt, Artificial Sequence; identical to SEQ ID NO: 10852
  Cpf1 variant mRNA product

SEQ ID NO: 10863 - RNA, 4510 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10864 - RNA, 4489 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10865 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10866 - RNA, 4224 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10867 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10868 - RNA, 4224 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10869 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10870 - RNA, 4224 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10871 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10872 - RNA, 4224 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10873 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10874 - RNA, 4224 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10875 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10876 - RNA, 4224 nt, Artificial Sequence; identical to SEQ ID NO: 10866
  Cpf1 variant mRNA product

SEQ ID NO: 10877 - RNA, 4245 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10878 - RNA, 4224 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10879 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacaagcggcccgccgccacgaagaaggccggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10880 - RNA, 4344 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacaagcgccccgccgcgacgaagaaggccgggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10881 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacccaguucgagggcuuuacaaaccuguaccaagugagcaagacucucagauucgaacuuaucccccaggggaaaacgcugaagcacauucaggagcagggauuuauagaagaggacaaagccaggaaugaucauuauaaggaauugaaaccuaucauugaccggaucuacaagaccuaugcugaucaaugcuuacagcugguccagcuagacugggagaaccucuccgcagccauugauucuuaccgcaaggagaaaacagaagagacucgaaaugcgcugaucgaggaacaggcuaccuaucguaacgccauacacgacuacuucaucgguagaacagauaaucuuaccgacgcaauuaacaagaggcaugccgagaucuauaaaggccuguuuaaggcugaauuguucaaugggaaaguucucaagcaacugggaacugugacaaccacggagcacgaaaacgcacugcuccggucauuugauaaguucacuaccuacuuuaguggcuucuacgagaaucgcaaaaacguauuuagcgccgaagacauuuccacagcuaucccacauagaauagugcaggauaauuucccgaaguuuaaagagaacugucacauuuucacuagguuaaucaccgccguccccucucugcgggagcacuucgaaaaugugaagaaagcgauugguaucuuuguuucgacaucaaucgaggaaguguucagcuuuccuuucuauaaccagcuuuugacccagacgcaaauugaccuguacaaucagcuacucgggggaauaagucgcgaggcaggcacugaaaagaucaaaggccugaacgagguccuuaaccuggccauucagaagaaugaugagacagcucauaucauagccuccuugccacaccgauuuauuccccucuucaagcaaauccugucugacagaaacacccuuagcuuuauccuggaagaguucaaauccgacgaagaggugauucagucauuuugcaaguauaaaacucuccuuaggaaugaaaacguacuggagacagcagaggcuuuguucaaugaacuaaacaguaucgaucugacccauauuuuuauaagccacaagaaacucgagacgaucucuuccgcccugugugaccacugggauacccuucggaaugcgcuguacgaacgucgcauuucagaguugacagggaagaucacuaagagcgccaaagagaagguucagagaagucucaaacaugaagacaucaaccugcaggagauuauaucugcagcuggaaaggaauuauccgaggccuucaaacaaaagaccagcgaaauccugucgcacgcucaugccgcacuagaucagccucucccaacaacucugaagaaacaggaggagaaggaaauucuuaaaucucaguuggacucccugcucggucuguaucaccuucuggauugguuugccguggacgagucaaaugaagucgaucccgaguucagugcuagguugaccggcaucaagcucgaaauggagccuagccuguccuucuacaacaaagcgcggaauuaugcaacaaagaagccauacucuguggagaaauuuaaguuaaacuuccaaaugccgacccuggccagcgggugggacgugaauaaagaaaagaacaauggagcuauucuauuugucaaaaacggccucuacuaucuggguaucaugcccaagcagaaagggcgauacaaggcccuuucauucgagccuacugaaaagacgagugagggauuugauaaaauguauuacgacuauuucccagacgcagccaagaugauacccaaaugcuccacacaguugaaggcuguuaccgcccauuuucagacucacaccacaccuauccugcucagcaacaauuucauugaaccacuggagaucaccaaagagauuuacgauuuaaacaaucccgaaaaggagccgaagaaauuucaaacugcauaugcgaagaaaacaggcgaccagaagggcuaccgcgaagcucuguguaaauggaucgauuucacgagagacuuucuuucuaaguacaccaagacuacaucaauagauuugaguagccucaggccuuccucucaguauaaagaccugggggaguacuaugccgagcuaaacccccugcucuaccacauuucguuccagcggaucgcagaaaaggagauuauggaugccguggaaaccggaaaacuguaucuuuuucaaaucuacaauaaggacuucgcuaaaggucaucacggcaagccaaacuugcauacacuguauuggacuggguuauucagcccugagaaucucgccaagaccuccauaaaacugaacggacaggcagaauuauuuuaccgccccaagucaagaaugaaaaggauggcucaccgucugggcgagaagauguugaauaaaaagcucaaagaucagaagacgccaauccccgacacccuguaccaagagcuauaugauuacguaaaccaccggcugagucaugaccucucugaugaagcccgagcgcugcuuccuaaugugauuacaaaggaggucagccacgaaaucauuaaagacagaagguucacuuccgacaaguuuuucuuucaugugccaaucaccuugaacuaucaggccgcuaauucaccgagcaaauucaaccagcgcguuaaugcauaccugaaggagcaccccgaaacaccuauaauugguaucgauagaggggagcggaacuuaaucuauauuacugugaucgacucuaccggcaaaauucucgagcagaggucccugaacacgauacaacaguuugauuaccagaagaaacuugacaaucgcgaaaaggagcgagucgccgcucggcaggccuggagugugguaggaacaaucaaggaucugaaacaaggcuaucuaagccagguuauucaugaaaucguggaccucaugauucacuaccaggcagucgugguccuggagaacuugaauuucggguuuaagucuaaacguaccggaaucgcggaaaaggccguguaccagcaauucgagaagaugcugauagauaaauuaaacugccucguucugaaggacuauccagcugagaaaguggguggcguacuuaaucccuaccagcugacugaucaguuuacauccuucgccaagauggggacccaaucaggauucuuguuuuaugucccugcaccauacaccaguaaaaucgacccccucacuggcuucguggauccguuuguuuggaagacaauuaagaaccacgaaagcagaaaacauuuccuggaggguuuugacuuccuacacuaugaugugaagacgggggacuuuauccugcauuucaaaaugaauaggaaccuuucguuucagcgcggccucccuggauucaugccagcuugggacauugucuuugaaaagaaugagacccaguucgaugccaaaggcacucccuuuaucgcagggaagcggauagugccuguaauugagaaccacagauucacaggaagguaccgagaccuguaucccgccaaugaauugaucgcucuguuagaggaaaaggguaucguguuccgcgauggcuccaacauucucccaaaacugcuugagaaugacgauucucaugcgauagacaccaugguugcccugauccggagcgucuugcagaugagaaacucaaaugcagcuacaggggaagauuacauuaacaguccugugagggaccucaacggaguguguuuugauucccguuuccaaaaucccgaguggccaauggacgccgaugccaacggcgcuuaccacaucgcacugaagggucagcuacugcuuaaucaccucaaagagucuaaggaccugaaauugcagaacgggauuagcaaucaggacugguuagccuauauccaagaacugcgcaacaagcggccggcggcuacuaaaaaggccggccaggcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10882 - RNA, 4344 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugagcaucuaccaggaguucgugaacaaguauucccugucuaaaacccucagauuugaacuuauuccccaaggcaagacacuggagaauauaaaagccaggggguugaucuuagacgaugaaaagcgggcuaaagacuacaagaaggcaaaacagauuaucgauaaguaucaccaguucuuuauugaggaaauccugucaagugucugcauaagcgaggaccuacuccagaacuacuccgauguuuauuucaaacugaagaaaucugacgaugacaaucuucaaaaggauuuuaagucggccaaagacacuaucaagaaacagauuucagaguacaucaaggauagcgaaaaauucaagaaccuguuuaaucagaacuugauugacgcgaaaaagggacaggagagugaucucauccuguggcugaagcaauccaaagacaaugguauagaacucuucaaggcuaacucugacauuacggauaucgacgaggccuuagagauuaucaagagcuuuaagggcuggaccacauauuucaaaggguuucaugaaaaucgcaagaacguguacuccucaaaugauaucccuacaaguauuauauaccgaaucguagacgauaaccugccaaaguuccuugagaauaaagcaaaguaugagagcuugaaagacaaggccccggaggcuauuaacuacgaacagaucaaaaaggaucuggcagaggagcuaaccuuugacauagauuauaagacaucugaagugaaucagcgugucuucucccucgacgagguguucgaaauugccaacuuuaacaauuaccugaaccagucaggaaucaccaaauucaauacuaucauuggcgguaaguuuguuaacggggagaauacaaaaagaaagggaaucaacgaauauauuaaucuuuacagccaacagauaaacgauaaaacccugaagaaguauaaaaugaguguguuguucaagcagauccucucugacacggaguccaagagcuuugucauugacaaacuggaggaugacucggaugugguaacuaccaugcaaucuuucuacgaacagaucgcugccuuuaaaacaguugaggaaaaguccaucaaagagacuuuaucacuccuguucgacgaucuuaaggcgcagaagcuggacuugaguaaaauuuacuuuaagaaugauaaaagccuaaccgaccugucccagcaaguguucgaugacuauucugucauaggcacagcagugcucgaauacaucacccagcagauugcccccaagaaccuggauaauccuagcaaaaaggagcaggagcuuaucgcuaagaaaacggaaaaggccaaauaucugucauuggagacuauuaagcucgcacuggaagaguuuaacaaacacagggacaucgauaagcaaugucgguucgaggaaauauuagcuaauuuugccgcgaucccaaugauuuucgacgagaucgcccagaacaaggacaaucuggcacagauuaguaucaaauaccagaaccaaggcaagaaagaucuacuccaggcuuccgccgaagacgaugugaaggcuauaaaagaccugcuugaucagacaaacaauuugcugcauaagcucaagauuuuccacaucagccagucugaggacaaagccaacauucuggauaaggacgaacauuuuuaucuugucuucgaggagugcuacuuugaacuggcaaauaucguucccuuguauaacaaaauacgcaauuacaucacccaaaagccuuacucagaugagaaauucaagcucaacuuugaaaauaguacucuggccaacgggugggacaaaaauaaggagccagauaacacagcuauuuuauucaucaaggacgauaaauauuaccugggagugaugaauaagaaaaacaauaagauuuuugacgacaaagcgaucaaggaaaacaagggugagggcuauaaaaagauaguauacaaacuacuccccggggcaaauaagaugcugccuaaaguguucuuuagcgccaaguccauuaaguucuauaacccaucugaggauauccuuagaaucaggaaccacucgacccacacgaaaaauggaagcccgcagaagggcuacgaaaaauuugaguucaacauugaagacugucggaaguuuaucgauuucuauaaacaguccauuucaaagcaucccgaguggaaggacuucgguuuucgcuucagugauacccaacgauacaauucuauagacgaauuuuacagagaggucgagaaccagggguauaaauugacauucgaaaauaucagcgaguccuacauugauucagugguuaaccagggaaagcuguaucucuuucagaucuacaauaaagacuucagcgcuuauucuaagggcaggccuaaccugcacacuuuauacuggaaagcccuguuugaugaacggaaucuucaagacguggucuauaaguugaacggcgaggcagaacucuucuaccguaagcaguccauucccaaaaagaucacccauccagccaaagaagcuauagccaauaagaacaaagauaauccuaagaaagagaguguguuugaauacgaccugaucaaggacaagcgcuucacagaggauaaauuuuucuuccacugcccaauuacuaucaacuuuaagagcucuggggcaaauaaauucaacgacgaaauuaaccuacugcucaaggagaaagcgaaugauguacacauccuguccauagacagaggagagaggcaucuugcuuauuacaccuugguugaugguaagggcaacauuaucaagcaggacacauuuaauaucauugggaacgaucggaugaaaaccaauuaucacgacaagcuggccgcaauagaaaaagaucgagacucagcccgcaaggauuggaaaaagaucaacaauauuaaggagaugaaagaaggauacuuaagucaggugguccaugagaucgcuaagcucgugauugaauauaacgccaucgucguguucgaggaccugaauuuuggcuucaaaagagguagguuuaagguugagaaacaaguguaccagaaacuugaaaagaugcugauagagaaauugaacuaucucguauucaaggauaaugaauuugacaaaacugggggcguccugcgggcauaccagcuaacggcucccuucgagacauuuaagaaaaugggaaagcagaccggcaucauuuacuaugugccggccggguucacuagcaaaaucuguccuguuaccggauuugugaaccaacuguaccccaaguaugaaucggucuccaagucucaggaguucuucagcaaauuugacaagauuugcuacaaucucgauaaagguuauuucgaguuuucauucgacuacaagaacuuuggcgauaaagcggccaaggggaaguggacaaucgcuaguuucggaucccgccugauaaauuuuagaaacucugacaaaaaucacaacugggauaccagggaaguguauccaacuaaggagcuugaaaaauugcugaaggacuacagcauugaguacggccauggugaguguaucaaagcagccaucugcggggaauccgauaagaaguucuuugcuaaauuaacaucaguacucaacacgauucugcagaugcguaauagcaagaccggcacugagcuugacuaucugaucaguccuguggccgauguuaacggaaauuucuuugacucucggcaagcacccaaaaacaugccacaggaugcggacgccaauggcgcuuaccacauagggcuaaagggacucaugcuguugggucgaauuaaaaacaaucaggaaggcaagaagcugaacuuagucaucaaaaaugaggaauauuucgaguuugugcagaacagaaauaacaagaggcccgccgcaacuaaaaaggcugggcaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10883 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacaagagaccugcugccaccaaaaaggccggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10884 - RNA, 4344 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaaaaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacaagagaccggccgccacaaagaaggcuggccaagccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10885 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacacaauucgaaggcuucaccaaccuauaucaaguuaguaaaacacuacguuucgaacuaauaccgcaaggaaaaaccuuaaaacacauacaagaacaaggcuuuauagaagaagacaaagcacgaaacgaucacuacaaagaacuaaaaccgaucauagaccguaucuacaaaaccuacgcagaccaaugucuucagcuaguucaacuugacugggaaaaccugagcgccgcaauagauagcuaucgaaaagagaaaacagaagaaacuagaaacgcuuugauagaagaacaagcuacauauagaaacgccauacaugacuauuucauaggaagaacugacaaucuuacagacgccauaaacaaaagacacgcugaaauauauaaaggacuauuuaaagcagaacuguucaaugguaaaguacuaaaacaacucggaacgguuacaacaacagaacacgaaaaugcucuacuuagguccuuugauaaauucaccacauacuuuucuggauucuaugaaaaccguaaaaaugucuuuucugcagaagauauaucaacagcgauuccacauagaauaguucaagauaacuuucccaaauucaaagaaaauugccacaucuucacucgucuaauaacagcaguuccaaguuuacgugaacacuuugaaaacgucaagaaagcaauaggcauauuuguuaguacaagcauagaagaaguuuucucauuuccauuuuacaaucagcuccuaacacaaacccaaauagaccuauacaaccaacuauugggaggcauaagcagagaagcaggcaccgagaaaauaaaaggccugaaugaaguacuaaaucuagcaauucagaaaaacgaugaaaccgcacacauuaucgcuucauuaccucaccgauuuauaccgcuauucaaacaaaucuuauccgacaggaauacacucaguuuuauauuagaagaauuuaaaagugacgaagaagucauacaaucauuuuguaaauacaaaacacuacuacgaaacgaaaacguccuagaaacugcagaagcacucuucaaugaauuaaauucuaucgacuuaacacacauauuuauaucacacaaaaaguuagaaacuauaucaucagcuuuaugugaucacugggauacacucagaaaugcacuguacgaaagacgaaucucugaacucacagguaaaauuacaaaauccgccaaagaaaaaguacaaagaucacucaaacaugaagacauuaaccuucaagaaauaauuucagcagcaggaaaagagcuuucagaggcuuucaaacagaaaacuucagaaauauuaagucacgcacacgcagcccuugaccaacccuuaccaacuacccuuaagaaacaagaagaaaaagaaauacugaaaucgcaauuagacucacugcuaggucuauaucaucuauuagacugguucgcaguagacgaaucaaaugaagucgacccagaguucucugcacgacuaaccggaauuaaacuggaaauggaaccgucacuuaguuuuuacaacaaagcacgaaacuacgccacuaagaaacccuauuccgucgaaaaauuuaaacuuaauuuccaaaugcccacacucgcaucaggaugggaugucaauaaagagaaaaacaauggcgcaauacuauuugucaaaaacggacuauacuaucucggaauaaugccaaaacaaaaaggucguuacaaagcacucucauuugaaccuacagagaaaacaucagaaggauuugacaaaauguauuaugacuauuucccagacgcagcaaaaaugauacccaaauguucaacacaguuaaaagcuguuacagcacauuuucaaacacacacuaccccuauccugcucucaaacaauuucauagaaccccuggaaauaaccaaagaaauauacgaccuuaacaacccagaaaaagaaccaaagaaauuccaaaccgccuacgccaagaaaacaggugaccaaaaaggauaucgagaagcgcuaugcaaauggaucgacuucacacgagacuuccuauccaaauauacaaaaacaaccucaauagauuuaucaucucuaaggcccucuucacaauacaaagauuuaggugaauauuaugcagaacuaaauccacuucuauaccacauaucauuccaacgcauagccgaaaaagaaauaauggacgccguugaaaccggcaaauuguaccuuuuccaaauauacaacaaagacuucgccaaaggacaccacgggaaaccaaacuuacacacauuauacuggacaggacuauucucaccagaaaaucuagcaaaaaccucaauaaaacuuaacggccaagcugaacuuuucuacagaccaaaaucccguaugaaacgaauggcucaccgcuuaggugagaaaaugcuaaacaagaaauuaaaagaccagaaaacacccauaccagauacucuauaucaggaauuauaugacuacguaaaucauaggcuaagucaugauuuaucugaugaagccagagcccuucuacccaauguuauuacuaaagaagugagucaugaaauaauaaaagauaggagauucacaucagauaaauuuuucuuccauguuccaaucacucuuaacuaucaagcagcaaacagcccuucaaaguucaaucaacgaguaaaugccuaccuaaaagaacacccugaaacuccaauaauagguauagacagaggggaaagaaaccucauuuauaucacagugauagauucuacaggcaagauccuugaacagaggagucuaaacaccauucaacaauuugacuaccagaagaaauuagauaauagggaaaaagaaagagucgccgcucgacaagcauggucaguuguagguaccauuaaagacuuaaaacaaggauaucuuucgcaaguaauucaugagaucguagaccuaaugauucacuaccaagcaguagucguacuagaaaaucuuaacuuuggauucaaauccaaaagaacaggaauagcugaaaaagcuguauaucagcaauucgagaaaaugcuaaucgacaaauugaacugcuuaguuuuaaaagauuauccugcggaaaaaguaggaggcguauuaaauccauaucaacuaaccgaucaguuuaccucauucgcaaaaaugggaacacagucaggcuuccuuuucuaugugcccgcaccauauacaucaaaaauagacccauuaacagguuuuguugacccauuuguguggaaaacaauaaagaaccacgaaucuagaaaacacuucuuagaaggcuucgacuuucugcacuaugauguuaaaacuggggacuucauacuucauuuuaagaugaaccguaacuuaucauuccaacgaggacuaccgggcuucaugccagcuugggacauagucuuugagaaaaacgaaacucaauuugacgcuaaaggaacucccuuuauugcaggaaaaaggauagucccaguuauagaaaaccauagauuuacuggucguuacagagaucuauacccagcaaacgaauuaauagcacuacuggaagaaaaaggaauaguauuccgagauggcagcaacauucuaccaaaacuucuagaaaacgacgauagucaugcaauagauacaauggucgcacuaaucagaagcgucuuacagaugagaaacaguaaugcugccacuggagaagauuauauaaauucaccaguaagagacuugaauggcgucuguuuugacucaagauuccaaaacccagaauggccaauggacgccgacgcgaacggcgcauaucacaucgcuuuaaaaggacaacuacucuuaaaucaccucaaagaaucaaaagaucuaaaauuacagaauggcauaucuaaccaagacugguuagcuuacauacaagaacuccgaaacaagaggccagcagcaacaaagaaggccggccaagcuaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10886 - RNA, 4344 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugucaauauaucaagaauuuguaaauaaauacucucuaucgaaaaccuugcgcuuugaacuaauaccacaaggaaaaacauuagaaaacaucaaagcuaggggcuugauacuagaugaugagaaaagggcaaaagauuacaagaaagcaaaacaaauaauagacaaauaccaccaauucuucauagaagaaauacuaucaagcguaugcauaagugaagaccuucuucaaaauuauagcgacguauauuucaaacuaaagaaaucagacgaugauaaccuccaaaaagacuuuaaaagugcaaaagacacaaucaagaaacaaauauccgaauauaucaaagacagcgagaaauuuaaaaauuuauucaaccaaaaucuaauagaugccaagaaagggcaagaaagcgaccuaauccuauggcuaaaacaaagcaaagauaauggaaucgaauuauuuaaagcaaacucagacauaacugacauagacgaagcauuagaaauaauaaaaucauuuaaaggauggaccaccuacuuuaaaggauuucacgaaaacaggaaaaacguauauagcaguaacgacauaccaaccucaauaauauaccgcauaguagacgauaaucuuccaaaauuucuugaaaacaaagcaaaauaugaaucucucaaagauaaagcaccagaagccauuaauuaugaacagaucaagaaagaccuagcugaagaacuaacauuugauaucgauuauaaaaccucagaaguuaaccaaagaguauuuagucuagacgaaguauucgaaauagcuaauuuuaacaacuaccuuaaucaauccggaauaacaaaauucaacacaaucauaggcggcaaauucguaaacggcgaaaacacaaaaagaaaaggaauaaacgaauacaucaaccuauauagccagcaaauaaacgacaaaacauuaaagaaauauaaaaugucuguacuuuuuaaacaaauccuuuccgacacugaaucuaaaaguuuuguaauagauaaacuugaagacgacagcgacguagucaccacaaugcagagcuuuuaugaacaaaucgcggcuuucaaaacggucgaagaaaaauccauaaaagaaaccuuaucacuuuuguucgaugauuuaaaagcacaaaaauuagaccucaguaaaauauacuuuaaaaaugacaaaucccucacugaucucucacaacagguauucgacgauuauucuguaauaggaaccgcaguacucgaauacauaacacagcaaauagccccuaaaaaucuagacaauccaaguaagaaagaacaagaacugaucgcuaagaaaaccgaaaaagcaaaauacuuaucacuugaaacaauaaaauuggcacuggaagaauuuaacaaacaccgcgacauugacaaacaauguagauucgaggaaauccuagccaacuucgcugccaucccuaugauauucgaugaaauagcacaaaacaaagacaaccuagcacaaauauccauaaaauaucagaaccaaggcaaaaaggaucuauuacaagcaucagccgaggaugacguaaaagccauaaaagaccuucucgaccaaacgaauaauuuacuacauaaacuaaaaauauuccacaucucacagucugaagauaaagcaaauauacucgauaaagaugaacacuucuaucucguauucgaagaaugcuacuucgaacuagcaaauauuguuccauuauacaacaaaauuaggaacuacauuacucaaaaaccauacuccgacgaaaaauucaaacuaaauuucgaaaauucuacacucgcaaauggaugggacaaaaauaaagaacccgacaauaccgcaauauuauucauuaaagaugauaaauauuaccuaggaguaaugaauaagaaaaacaacaaaaucuucgaugacaaagcuauaaaagaaaacaaaggagaaggauacaagaaaauagucuauaaauuacuacccggagcaaacaaaauguuaccaaaaguauuuuucagcgccaaaagcauaaaauucuacaauccauccgaagauauacuaagaauacgaaaccauucaacacauaccaaaaacgguucuccacaaaaagguuaugaaaaauuugaguucaauaucgaagacuguagaaaguuuaucgauuuuuacaaacaaagcauaucaaaacacccagaguggaaagacuuuggauuucgcuucuccgacacacagcgcuauaacuccauugaugaguucuaccgcgaaguagaaaaccaaggauacaaacucacauuugaaaacauuucagaauccuauauugauuccguaguuaaucaaggaaaauuauacuuauuccaaauauauaacaaagauuuuagcgcauacaguaaaggccgaccgaauuuacauacacuuuacuggaaagcauuauucgaugaaagaaacuuacaagauguaguauacaaauuaaauggagaagcagaacucuucuauagaaaacaauccauucccaagaaaauaacucauccagcaaaagaagcgauagcaaauaaaaauaaagacaacccgaagaaagaaucuguauuugaauaugaucuaauaaaagacaaaagauucacagaggacaaauucuucuuucacuguccuauaacaauaaauuucaaaucuuccggagcaaacaaauuuaacgaugaaauaaaucuauuacucaaagaaaaagcuaaugauguucauauucugaguaucgacagaggugaaagacauuuggcauauuauacccuaguagacggaaaaggaaacauaauaaaacaagauacauuuaacaucauaggaaacgaccgaaugaaaacaaacuaucacgacaaauuagcagccaucgaaaaagacagagacucagcaagaaaagacuggaagaaaauaaauaacauaaaagaaaugaaagagggauacuuaucacaaguuguccacgaaaucgcgaaacuggucauagaauacaaugcaauagucgucuuugaggacuuaaauuuuggauuuaaacgaggaagauucaaaguagaaaaacaaguauaccaaaaacuugagaaaaugcuaauagaaaaacuaaacuacuuaguauucaaagacaaugaguucgacaaaaccggaggcguacugagggcauaucaacuaaccgcaccauucgaaacguuuaaaaagaugggaaaacaaacaggaauaauauacuacguacccgcugguuucacaucaaaaaucugcccugugaccggauuugucaaccaacuguacccaaaauacgaguccguauccaaaagucaagaguucuucagcaaauucgacaaaauuugcuacaaccuagacaaaggcuauuucgaguuuucguucgauuacaaaaauuuuggugauaaagcagcaaaaggcaaauggacaauugcaucuuucggaagucgcuuaaucaacuucagaaacucggauaaaaaccauaauugggauacccgcgaagucuacccaacuaaagaauuagaaaaacuccuaaaagauuacagcauagaauacggacacggagaaugcauaaaagcagccaucugcggcgaaucagacaagaaauuuuucgcuaaacugacauccguacuaaacacuauauuacaaaugcgcaauagcaaaacaggaacggaacuugacuaucuuauuuccccaguagcugacguaaacggcaacuuuuucgacucucgacaagcaccgaaaaacaugccccaagacgcagacgccaauggggcauaccauauuggacugaaaggacuaaugcuauuaggucgaaucaaaaauaaucaagaaggcaagaaacuaaaucugguaaucaaaaaugaagaauauuucgaauuuguccaaaaccgaaauaauaagcgaccagcugcaacuaagaaagcaggacaagcgaaaaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10887 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacccaauucgagggcuucacuaaccucuaccagguaucaaaaacgcugcguuucgagcucauaccacagggcaaaacacucaagcauauacaagagcaaggcuucauagaagaggacaaggcacggaacgaccacuacaaagaacuaaaacccaucaucgaccgcauauacaaaaccuaugcagaccaaugucuacagcuaguccaacuagacugggagaaccucuccgcggcuauugacaguuaucgcaaagagaaaacagaagaaacccgcaaugcucuaauagaagaacaggccacguaucgcaacgcuauccacgacuacuucaucgggcguacagacaaccuaaccgacgcgauuaacaaaagacacgccgaaaucuacaagggccucuucaaggcagaacucuucaacggaaaaguccuaaagcaacuggguacagucaccaccacagaacacgaaaacgcccugcuccggucauucgacaaauucacaaccuauuucuccggauucuaugaaaaccgcaaaaacguauucucugcugaagacaucucuacagccaucccccacagaaucguacaagacaacuuccccaaguucaaagaaaacugccacaucuucacgagacucaucaccgcaguaccuucgcuacgagaacacuuugagaacguaaagaaagccauagguaucuucgucuccaccuccaucgaggaaguguucucguucccauuuuacaaccaacugcugacccaaacccaaaucgaccuauacaaccaguuacuuggagguauaagccgggaagccggaaccgagaaaaucaaaggccugaacgaaguacuaaaccucgccauccagaaaaacgacgaaacagcccacauuaucgcaucccuuccgcaucgcuucauuccccucuucaaacaaauacucucagaccggaacacccuuagcuucauccuagaagaguuuaaguccgacgaagaagucauucaauccuucugcaaauacaaaacccuccuucgcaacgaaaauguacuagaaaccgccgaggcccucuucaacgaacucaacuccaucgaccucacccacaucuucaucucccauaagaaauuagagaccauauccucagcgcuuugcgaccacugggacacccuccgcaacgcccucuaugagcgacgaaucuccgaacucaccggcaaaaucaccaaaucagcuaaagaaaaaguccaacgcucgcuaaaacacgaggacaucaacuuacaagagauaaucuccgccgcugguaaagagcucuccgaggcauucaaacagaaaaccuccgaaauacuaucccacgcccaugcagcccuggaccaaccgcuccccacaacccucaagaaacaagaggaaaaagagauccuaaaaagccaacuagacucccuccuaggccuauaccacuugcucgauugguucgcagucgacgaauccaaugaagucgauccagaguucagcgcgcgcuuaacaggaauaaaacuagaaauggaacccucccuuaguuucuacaacaaagcccgaaacuacgccacgaagaaaccguacuccgucgaaaaauuuaaacucaacuuucaaaugcccacucucgcaagcggcugggacguuaacaaagagaagaacaacggcgccauacuauucgucaaaaacggacucuauuacuuagguaucaugcccaaacaaaaaggccgcuacaaagcccugagcuucgaacccaccgaaaagacaucagaaggcuuugacaaaauguauuaugauuacuuccccgacgcagccaagaugaucccaaaaugcucuacgcaacuaaaagccguaaccgcccacuuccaaacccacaccaccccgauacuacuauccaauaacuucauagaaccgcucgaaauuaccaaagagaucuacgaccucaacaacccagaaaaggagcccaagaaauuccaaacagccuacgcaaagaaaaccggagaucaaaaaggcuaccgcgaagccuugugcaaauggauagacuuuacccgugacuuccuuucaaaauacaccaaaacaaccagcaucgaucuaucgucuuuacgccccucaucacaauacaaagaccugggcgaguacuacgcggagcugaacccccuacuauaccacaucucauuccaacgaaucgcagaaaaagaaaucauggacgccgucgaaacggguaaacuauaccucuuucaaaucuacaacaaagacuuugccaagggccaccacggaaagccaaaccuccacacccucuacuggacaggcuuauuuagcccagagaaccuagcaaagacauccauaaaacuuaacggacaagcagaacuauuuuaccggccaaagucacgcaugaaaaggauggcacaccgccuaggagaaaagauguuaaacaaaaagcuaaaggaucagaaaacgccaauccccgacacauuauaccaagaacucuaugacuacgucaaccaccgccugucgcacgaccuaucggacgaagcacgcgcccuccugccaaacguaaucaccaaagagguaucgcacgagaucaucaaagacagacgauucaccucugacaaauucuucuuccauguccccauaaccuuaaacuaccaagcagcaaacuccccgagcaaguucaaccaacgaguuaaugccuaccuaaaagaacacccagagacaccgauaauaggcaucgaccgaggcgaacgcaaucucaucuacaucaccguaauugacucaaccgggaagauccuagagcaacguagccugaacacaauacagcaauuugauuaccaaaagaaacuagacaaccgcgaaaaagagagagucgccgcccgacaggcuuggagcguagucggcacaaucaaagacuugaagcaaggauaccugagccaagugauccacgagauuguggaccucaugauucacuaccaagcaguagugguacucgaaaaccugaacuucggcuucaaaagcaaacgcacaggcaucgccgaaaaagccguauaucaacaauucgaaaagaugcucauagacaagcucaacugccuggugcuaaaggacuauccggcggagaaaguaggagggguccucaaccccuaccaacucaccgaccaauuuaccucauuugcgaaaauggggacccaauccggauuccuuuucuacguccccgcaccguacacaucuaagaucgacccauuaacaggauucguagacccauucguguggaaaaccaucaaaaaccaugagagccgaaagcacuuccuugaaggauucgacuuccuucacuaugacgucaaaacaggggacuucauucuacacuucaaaaugaaucguaaucuguccuuucaacgaggucuacccggauucaugcccgcgugggacaucgucuucgagaaaaacgaaacacaauucgacgcaaaagguacgccauuuaucgcuggaaagcgcaucguacccgucaucgaaaaccaccgauucaccgggcgcuaccgugaccuguaccccgccaacgaacucaucgcacuccuggaagaaaagggcauaguuuucagagacggcucaaacauccugcccaagcuccucgaaaacgacgacucucaugcaauugacacaaugguagcacuuauacgaagcguuuuacaaaugcgcaacaguaacgcugccacaggagaagacuauaucaacucccccguccgcgaccucaacggcguuugcuucgacucaagguuccagaaccccgaauggcccauggacgccgacgccaacggcgccuaucacaucgcacuaaagggccaacuccuccucaaucaccuaaaagaauccaaagaccucaagcuccagaacgguauauccaaccaagacuggcucgcauacauacaagagcugcgaaacaagcgccccgccgccacuaaaaaggcagggcaagccaagaaaaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10888 - RNA, 4344 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugucaauauaccaggaguucgucaacaaauacagccucagcaaaacccuccgcuucgaacucauaccccagggaaaaacccuagaaaacaucaaagcgagaggccucauccuagaugacgagaaacgcgcaaaagacuacaagaaagcaaaacaaaucauagauaaauaccaucaguucuucauagaagaaaucuuaagcuccgucugcauauccgaagaccuccuacaaaacuacucugacgucuacuucaaacugaagaagagugacgacgacaaccuccaaaaagacuucaaaucggcaaaggacaccaucaagaaacaaaucucugaauacauaaaagacuccgaaaaauucaaaaaucuguucaaccaaaaccugaucgacgccaaaaagggccaagaaagcgaccucauccuguggcucaaacaaagcaaagauaacggaauagaacuauucaaggcgaacuccgacauaaccgacauagacgaagcauuagaaauuaucaaaucguucaagggguggacgacauacuucaaaggcuuccacgaaaaucgcaagaacgucuacucuagcaaugacauccccaccagcaucaucuauagaauagucgacgacaaccuaccaaaauuccuugagaacaaagccaaauacgagucccuaaaggacaaagcucccgaagccaucaauuacgaacaaauaaagaaagaccuagccgaggaacucaccuucgacauagacuacaaaaccuccgaggucaaccaacgggucuucagucuggaugaaguuuucgaaauugccaacuucaacaacuaccucaaucagucaggcauuacaaaauucaacaccauaauaggcggaaaauucguaaacggcgaaaacaccaaacgcaaaggaaucaacgaguacaucaaccucuauucgcaacagauaaaugacaaaacacucaagaaauacaaaaugaguguguuauucaagcagauccuaucggacaccgaaucuaagucguucgucauagacaagcuagaggacgacagcgacguugugacaacgaugcagucuuuuuacgaacagaucgcagcguuuaaaaccgucgaagagaaaagcaucaaagaaacccucagucuguuauucgaugaccuaaaagcacaaaaacucgaccucagcaaaaucuacuucaaaaacgacaagucccuaacggacuuaucccagcaggucuucgacgacuacuccgucauuggcaccgcagugcuagaguacaucacccaacaaauagcucccaaaaaccuggacaacccgaguaagaaagagcaagagcuaauagccaagaaaacagagaaagccaaauaccuaagccucgaaacaauaaaacuugcauuagaagaguucaacaaacaccgcgacauagacaaacaaugccgcuuugaagagauacucgcuaacuucgccgccaucccaaugaucuuugacgagauagcucaaaacaaggacaaccucgcgcaaaucucaauaaaauaccaaaaccaaggaaagaaagaucuccuacaagcaagcgccgaagaugacgucaaagcgaucaaagaucuacucgaccagacaaauaacuugcugcacaagcucaaaauauuccacaucagccaauccgaggacaaggcgaacaucuuagacaaagacgagcacuucuaccucgucuucgaagaaugcuacuuugagcuggcaaacaucgugccccuguacaauaaaaucagaaacuacaucacccaaaaacccuacuccgacgaaaaauucaagcugaacuucgaaaauucgacccuggccaauggcugggauaagaacaaagaacccgacaacaccgccaucuuauucaucaaagacgacaaauauuaccucggagucaugaauaagaaaaacaacaaaaucuucgacgacaaagcaauaaaagaaaacaaaggagaagguuacaagaaaaucguauacaaacuacuucccggagccaacaaaaugcugcccaaagucuucuucagcgcuaaaagcauaaaauucuacaacccaagcgaggauauccuacggaucaggaaccacagcacccacaccaagaacggcagcccccagaaaggcuacgagaaguucgaguucaacauagaagacugucggaaauucauagacuucuacaaacaaucgauaaguaaacaccccgaauggaaggacuucggauuucgguucucugauacccagcgcuacaacuccauagacgaguucuaucgagaaguagaaaaccaaggcuacaaacucacuuucgaaaacaucuccgaaagcuacauagacagcguuguuaaccagggcaaacuguaccucuuccaaauauacaacaaggacuucagcgccuacucgaaaggccggccuaaucuacacacacucuacuggaaggcucucuucgacgaaaggaaccugcaagacguuguauacaagcucaacggcgaggcagaacucuucuaucggaaacaaaguauccccaaaaagauaacccacccagccaaagaggccaucgccaacaaaaacaaagauaaccccaagaaggagagcguguuugaguacgaccuaauaaaagacaaacgcuucacggaggacaaguucuucuuucacuguccaaucacaauaaauuucaaauccuccggcgcuaacaaauuuaacgacgaaauaaaucucuuacucaaggaaaaggccaacgacguccacauccucucgauagacaggggcgaacggcaccuugcauauuacacacucguugacggaaaaggaaacaucauaaaacaagacacauucaacaucaucggcaacgaccgaaugaagaccaauuaccacgacaaacuagccgcuauagagaaagauagagacagcgcccgaaaggacuggaagaaaaucaacaacauaaaagagaugaaagagggauaccucucccagguggugcacgaaauagcgaaacucgucaucgaguacaacgcaauuguaguuuucgaggaucucaacuucgguuucaaacgcggccgcuucaagguagaaaagcaaguguaccaaaaacucgaaaagaugcugaucgaaaaacucaacuaccucguauucaaagauaacgaguucgacaagaccgggggcguguuaagagcuuaccaacucaccgcgccuuuugaaacauucaagaaaaugggcaaacagaccggcaucaucuacuacguccccgccggguucacguccaaaaucugcccugugaccggguucgucaaucaacuguaucccaaguacgaauccgucucaaaaucgcaggaguucuucagcaaguuugauaaaauaugcuacaacuuagacaaaggcuacuucgaauuuuccuucgacuacaaaaacuucggggacaaagccgccaaaggcaaguggaccauagccagcuucggcagccggcucauaaauuuccgcaauucugacaaaaaccacaacugggacacucgagagguguaccccacuaaggaacucgaaaaguugcuuaaggacuacuccaucgaauacggacacggggagugcaucaaggccgccauaugcggcgaauccgacaaaaaguucuucgccaagcuaaccucgguccuaaacacaauccugcaaaugcgcaauagcaagacggggaccgagcuugacuaccucauaucaccuguagccgacguaaacggaaacuucuucgacucacgccaagcccccaaaaacaugccacaagacgcagacgccaacggagcauaccacauagggcuaaagggccuuaugcuccuaggacgcaucaaaaacaaccaggaaggaaagaaacucaaucuggucaucaaaaacgaagaauauuucgaguucguacaaaaccgcaacaacaaacggcccgcagccacuaagaaagccggccaagccaagaagaagaaauaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10889 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacccaguucgagggcuucacgaaccuguaccaggugagcaagacgcuccgcuucgagcugaucccccaggggaagacccuaaagcacauccaggagcagggcuucaucgaggaggacaaggcccggaacgaccacuacaaggagcucaagccgaucaucgaccgcaucuacaagaccuacgccgaccagugccugcaacugguacagcucgacugggagaaccuguccgcggccaucgacagcuaucggaaggagaagaccgaggagacgcgcaacgcccugaucgaggagcaggccacauaccggaacgccauucacgacuacuucaucgggcgcaccgacaaccucaccgacgcgaucaacaagcggcacgccgagaucuacaagggccuguucaaggccgagcuauucaacgggaaggugcucaagcagcugggcacggugaccaccaccgagcacgagaacgcccugcuccgcuccuuugacaaguucacgaccuacuucagcggcuucuacgagaaccggaaaaacgucuucuccgcggaggacauuagcaccgccaucccccaccgcaucgugcaggacaacuuccccaaguucaaggagaauugucacauauucacccggcugaucacggccguucccucccugcgcgagcacuucgagaacgucaagaaggccaucgggaucuuugugagcaccuccaucgaggagguguucagcuucccguucuacaaccagcugcugacccagacccagaucgaccuguacaaccagcuccugggcgggauaucccgggaggccggcacggagaagaucaaggggcugaacgagguacucaaccuggcgauccagaagaacgacgagaccgcucacaucaucgccagccugccccaccgcuucaucccccucuucaagcagauccuguccgaccggaacacccugagcuucauccucgaggaguucaaguccgacgaggaggugauccagucguucugcaaguacaagacccugcugcgcaacgagaacgugcucgagacggcagaggcccuguuuaacgaguuaaacuccaucgaccucacccacaucuuuaucagccacaagaaacuugagaccaucuccagcgcgcugugcgaccacugggauacccuccggaacgccuuguacgagcgccggaucagcgagcugacgggcaagaucaccaaauccgccaaggagaaaguccagcgcagccucaagcacgaggacaucaaccugcaggagaucaucuccgccgccggcaaggagcugagcgaggcguucaagcagaagaccucugagaucuugagccacgcccacgccgcacuggaccagccccucccgaccacgcucaagaagcaggaggagaaggagauccugaagucccagcuggacuccuugcucgggcuguaccaccuccucgacugguucgccguggacgaguccaacgagguggacccugaguucagcgcgcgucugaccggcaucaagcuggagauggagcccucgcucucauucuacaacaaggcccgcaacuacgccaccaagaagcccuacuccgucgagaaguucaagcugaacuuccagaugccgacccuggccuccgggugggacgugaacaaggagaagaacaacggcgcgauccucuucgugaagaacggccuguacuaccuggggaucaugcccaagcaaaagggccgauauaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaacccggagaaggagccgaagaaguuccagacugccuacgcgaagaagacgggcgaccagaaaggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuucagcgcaucgcggagaaggaaaucauggacgcaguggagaccggaaagcuguaccucuuccagaucuacaacaaggacuucgccaaggggcaccacggcaagcccaacuugcacacccuguacuggaccggccucuucuccccggagaaccuggccaagacgagcaucaagcugaacgggcaggccgagcuguuuuaccggcccaagucccgcaugaagcggauggcgcaccgccugggggagaagaugcugaacaaaaagcucaaggaccagaagacucccauccccgacacccuguaccaagagcuguacgacuacgugaaccaccggcucagccacgaccuguccgacgaggcccgcgcccugcucccgaacgucaucaccaaggaggugagccacgagaucaucaaggaccggcgcuuuacguccgacaaguucuucuuccaugugcccaucacccugaacuaccaggccgcaaacagccccuccaaguucaaccagcgggucaacgcuuaccugaaggagcacccggagacccccaucaucggcaucgaccgcggcgagaggaaucucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggcuaccugagucaggucauccacgagaucguggaccucaugauccacuaucaagcgguggucgugcuggagaaccugaacuucggcuucaaaagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcacccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgcuaaggggaccccauucaucgccggcaaacggaucgugcccgucaucgagaaccaccgcuucaccgggcgguaccgcgaccuguacccagccaacgagcugaucgcgcuccuggaggaaaaaggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggucagcuccugcugaaccaucucaaggaguccaaggaccugaagcugcagaacgggaucagcaaccaggacuggcucgcguacauccaggagcugcgcaacaagcgacccgcagccacgaagaaggccggccaggccaagaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10890 - RNA, 4344 nt, Artificial Sequence; identical to SEQ ID NO: 10880
  Cpf1 variant mRNA product

SEQ ID NO: 10891 - RNA, 4365 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugacgcaauuugaaggauucaccaaccuguaucaagucucaaaaacacucagguucgaacuaaucccccaagggaaaacucugaaacauauccaagagcaaggcuucauagaagaagacaaagcacgcaacgaucauuacaaagagcuuaaaccaauuauagacagaauauacaaaacauacgcugaccaauguuuacaauuaguccaacuagacugggaaaaucuauccgccgcaaucgacucuuaccgaaaagagaaaacugaagaaacacgcaacgcacuuauagaagaacaagcaacauacagaaacgcaauacaugacuacuucauugggcgcacagacaaccuuacugaugcuauaaauaaacgccaugcugaaauauauaaaggacuuuuuaaagcagagcuuuucaaugguaaagucuuaaaacaguuaggcaccguaacaaccacugagcaugaaaacgcccuucuacguucguucgauaaauuuacaacauauuuuucaggcuuuuaugaaaaucgcaaaaacguauuuucagcagaggacauaaguacugcaauaccacauaggaucgugcaagacaacuuuccaaaauucaaagaaaauugccacauauucacaagacuaauaacggccguaccuucacuuagagaacauuucgaaaacgucaagaaagcuauaggaauuuucgucucgacaagcauagaagaaguauuuagcuucccauucuauaaccaacucuuaacucaaacacaaauagauuuauacaaucaacuauuaggaggaaucucaagagaggcaggaaccgagaaaaucaaaggacuuaaugaaguguuaaaucuugcaauucagaaaaacgaugaaacggcccauauaauugcaagucuaccccaccgcuucauccccuuauuuaaacaaauuuuaucagaucgaaauaccuuaaguuucauacuagaagaauuuaaaagcgaugaagaaguaauucaaaguuucugcaaauauaaaacacugcugagaaaugaaaauguacuagaaacugcagaagcauuauucaaugaauuaaacucuauagaccuaacccauauauuuauaucucacaagaaacucgaaaccauaucuucagcauuaugugaccauugggacacucuaagaaaugccuuauaugaaagacgcauuagugaacucacggguaaaauaaccaaauccgcaaaagaaaaaguccaacgcucucuaaaacacgaagacauaaacuugcaagaaauaauaagcgccgcaggaaaagaacuuucagaagcauuuaaacagaaaacgucagaaauccuaagucaugcacaugcagcauuagaccaaccucuucccacaacauuaaagaaacaagaagaaaaagaaauauuaaaaagucaauuagauucacuacucggucuuuaccaccuccuagauugguuugcaguagacgaauccaacgaaguagauccagaguucucugcacgcuuaacuggaauaaaauuagaaauggaaccaucccuaucuuuuuauaauaaagcacgaaacuaugcaacuaagaaacccuacucaguugaaaaauucaaacucaauuuucaaaugccaacucucgcauccgggugggacgucaauaaagagaaaaauaacggcgcuauucuuuuuguuaaaaacggucuuuauuacuuaggaauuaugcccaaacaaaaaggaagauauaaagcacugucguucgaaccaacugagaaaacaucagaaggcuucgauaaaauguacuaugauuacuuuccugacgcagcaaaaaugauuccaaaaugcucaacacaacucaaagcaguaacagcacacuuccaaacacacacaacaccaauacuauuaucuaauaauuuuaucgaaccacuagaaaucacuaaagaaauauaugacuuaaauaacccagaaaaagaaccaaagaaauuccaaacugcguaugcuaagaaaacaggagaccaaaaaggauauagggaagcauuauguaaauggauagacuuuacacgagauuuccuuaguaaauacaccaaaacaacaaguauagaucuaucaagccuacgaccaucaucacaauauaaagaccuaggagaauauuacgcggaacuaaacccucuacuauaccacaucuccuuucaacguaucgcugaaaaagaaaucauggaugcuguugaaacugguaaacuauaucuauuucaaauauauaacaaagacuucgcuaaaggucaccacggaaaaccaaaucuacauacacuauacuggacugguuuguucaguccagaaaaccuugccaaaacaaguauaaaauuaaauggucaagcagaacuauucuaccgacccaaaucacgaaugaaacguauggcccaucgauuaggugagaaaauguuaaacaagaaauuaaaagaccagaaaacaccaauaccagauacccuauaccaagaauuauacgauuacguaaaccauagacuaagccacgauuuauccgacgaagcaagagcacuacuaccaaacguaaucaccaaagaagucucgcacgaaauaauaaaggauagaagauucacaucugacaaauuuuucuuucacgucccaauaacucuuaauuaccaagccgcaaacuccccuuccaaauucaaccaacgaguaaaugcauauuugaaagaacauccggaaacaccuauuauuggaaucgaucgaggugaaaggaaccuaauuuacauaacaguuauagacagcacaggaaagauccuagagcaaagaagccuaaacacaauacaacaauucgauuaccaaaagaaacuugacaauagagaaaaagaaagaguagcugcaagacaggcuugguccguagugggcacuauaaaagaucucaaacaaggauacuuaucacaaguaauccaugaaauaguagaccuuaugauacauuaccaagcuguaguaguacuagaaaaucuaaacuuugguuuuaaaucgaaaagaaccgguauagcagaaaaagcuguauaccaacaauucgagaaaaugcuaauagauaaacuuaauugccuugucuuaaaagauuauccagcagaaaaaguuggcggagucuuaaauccauaucagcucacggaccaauuuaccucuuuugcaaaaaugggcacacaauccggauuuuuauucuauguaccagcaccuuacacaaguaagauugacccacuaacuggauuuguagacccuuuuguauggaaaacuaucaaaaaccacgagucacguaaacauuuucuagaagguuuugacuuucuucacuacgaugucaaaacgggagauuuuauauuacacuuuaaaaugaaccguaauuuaaguuuccaacgcggauuaccaggauuuaugccagccugggacauaguguucgagaaaaacgaaacacaauuugacgcaaaaggaacacccuuuauagcuggaaaaagaauuguaccaguuauugaaaaucauagauuuacgggacgauauagagaucuuuacccagcuaacgaacugauugcacuccuugaagaaaagggaauagucuuucgagauggcaguaacauauuaccuaaacuacuagaaaaugaugauucccacgcuauagacacaaugguagcccuuauaaggaguguacuacaaaugcgaaacucaaaugccgccacuggcgaagacuacaucaauagcccaguaagggaccuaaacggcguauguuuugacucuagauuucaaaacccugaauggccaauggacgcugaugcuaauggugcuuaccauauagcucuaaaaggacaacuacuguuaaaucaccugaaggaauccaaagaccuaaaacuacaaaacggaauaaguaaccaagacugguuagcauauauacaagaacuacgaaacaaaagaccagcugccaccaagaaagcuggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10892 - RNA, 4344 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugucaauuuaccaagaauuuguaaacaaauauagccucucaaaaacgcuacgauuugaacuaauuccacaaggcaaaacacuugagaauaucaaagccagaggcuugauacuugaugacgagaaacgcgccaaagacuacaaaaaagcaaaacaaauaauugauaaauaucaccaauuuuuuauugaagaaauacuaucuagugucuguauaucugaagaccuucuccaaaauuacagcgacguauauuuuaaauuaaaaaaauccgacgacgauaaucuacaaaaagacuucaaaucagcuaaagacaccaucaaaaaacaaauaagcgaauauauaaaagauagcgaaaaauucaaaaaccuauucaaccaaaaccuaaucgaugcuaaaaaaggccaagaaucagaucuuauacucuggcucaaacagucaaaagacaacggaauagaauuauucaaagcaaacagugauauaacagacauagacgaagcauuagaaauaauaaaauccuucaagggauggacuacauacuucaaagguuuccacgaaaacagaaaaaauguauacucgagcaaugacauaccaaccagcauaauuuacaggauaguagacgacaaucuaccaaaauucuuagaaaacaaagcaaaauaugaaaguuuaaaagauaaagccccagaagcaauaaacuaugagcaaauaaaaaaagaucucgcagaagaacuaacauucgauauagacuacaagacaucagaagucaaucaacgaguauuuucucuagacgaaguauucgagauugcaaacuucaauaacuacuuaaaucaaagugguauuacaaaauucaauaccaucauagguggaaaauucguaaacggagaaaacacaaaacgcaaaggcauaaacgaguacauaaaucucuauagucaacaaauuaaugacaaaacuuuaaaaaaauacaaaaugucuguccuuuucaaacaaauccuuagcgauacagagucaaaaucauuugucauagacaaacuggaggacgauagugacguaguaacuacaaugcaaagcuuuuaugaacagauugcugcuuucaaaacaguagaagagaaauccauaaaagaaacccucucuuuacucuucgacgauuuaaaagcccagaaauuagaucuuagcaaaauuuauuuuaagaaugacaaaaguuugacagacuuaucccagcagguuuuugaugacuacuccguaaucgguacagccguacuagaauauauaacccagcaaaucgcccccaagaaccuagauaacccuagcaagaaagaacaagaauuaauagccaaaaagacagaaaaggccaaauaccuuagucuagaaacaauaaaacuagcccuagaagaauuuaacaaacaucgagauauagacaaacaaugucgcuuugaagaaauccucgcuaacuuugcagcaauaccaaugaucuucgacgaaauagcacaaaauaaagacaaccucgcccagauaucaaucaaauaccaaaaccaaggaaagaaagaucuacuacaagccucagcagaggacgacguaaaagcuaucaaagaucuacucgaccaaacuaauaaccuucuacauaaauuaaaaaucuuccacauuucucaaagcgaagacaaggcaaauauacuagacaaagacgaacauuuuuaccuaguauucgaggaaugcuacuucgaacuagcuaacaucguaccuuuauauaacaaaaucagaaacuacauaacucaaaaaccauauucagaugaaaaauucaaacuuaacuucgaaaacucuacccucgcaaaugguugggacaagaacaaagaaccagacaacaccgcaaucuuauuuaucaaagacgauaaauauuaccuaggcgucaugaacaaaaaaaauaacaaaauauucgaugauaaagcaauaaaagaaaacaaaggcgaaggauacaagaaaauaguauacaaacuccuacccggugcaaauaaaaugcuaccuaaaguauuuuucagugccaaaagcauuaaauucuacaauccaagcgaagacauccuucgaauaagaaaccauucaacgcacacaaaaaauggaucuccacaaaaagguuacgaaaaauucgaauucaacauagaagacugccgaaaauucauagacuucuauaaacaauccauuaguaaacauccagaauggaaagacuuuggauuucguuuuucagauacccaacgauacaauaguauagacgaauucuacagagaaguagaaaaucaaggauauaaauuaacauucgaaaauauuuccgaaucuuauauagacaguguaguuaaucaaggcaaauuguauuuauuccagauauauaacaaagacuucagugccuacucaaaagguagaccaaaucuccacacccuuuauuggaaggcacuauuugacgaaaggaaccuccaagauguaguuuacaaacuaaauggcgaagcagaacuauuuuauagaaaacaaagcauccccaaaaaaauaacucacccagcaaaagaagcaauagcaaauaaaaauaaagacaacccuaaaaaggaaucagucuuugaauacgaccuaauaaaagauaaacgauuuacagaagacaaauucuucuuccacugcccaaucaccaucaauuucaaaagcuccggagcaaauaaauucaacgacgaaauaaaccucuugcuaaaagagaaagccaaugacguacacauacucaguauagauagaggagaaagacacuuagcuuacuauacacuuguagaugggaaagggaacauaauaaaacaagauacauuuaauauaauaggaaacgacagaaugaaaacaaauuaccaugacaaacuagcugcaaucgaaaaagacagagauagugcaagaaaagacuggaaaaaaaucaacaacauaaaagaaaugaaagaaggauacuuaagccaagucguacaugaaauagcuaaguuagugaucgaguacaacgcgauaguagucuucgaagaucucaauuucggcuucaaaagaggaagauucaagguagaaaaacaaguuuaucagaaauuagaaaagauguuaauagaaaaacugaacuauuuaguguucaaagauaacgaauuugacaaaaccggcgggguacuaagagcauaccaauuaacagcuccauucgagaccuucaaaaaaauggguaaacaaacagguauaauuuauuacguucccgccggauuuaccucaaaaauauguccuguuacuggauucguaaaccaacuauacccuaaguaugaaagugugaguaaaagccaagaauucuucucaaaauuugacaaaauauguuacaaccuggacaaaggauacuucgaauuuucauucgauuacaaaaauuucggugacaaagcugccaaaggaaaauggacgauagcauccuucgguucaagacuaaucaacuuccguaauuccgacaagaaccauaacugggacacaagagaagucuacccaacaaaagagcuagagaaacugcuaaaagauuauaguauagaauacggccauggcgaaugcauaaaagcggcaauuugcggagaauccgacaaaaaauuuuucgcaaaacucaccucaguacucaacacaauccuacaaaugagaaacucaaaaacagguacagaacuagauuacuugauuucucccguugcagauguaaacggaaauuucuuugauucgagacaagcaccuaaaaacaugccucaagaugcagacgcaaacggugcuuaccacauaggcuuaaaaggauuaauguuguuaggaagaauaaaaaauaaccaagaaggcaaaaaauuaaaucugguaaucaaaaaugaagaauacuucgaauucguacaaaauagaaacaauaagagacccgcugccacaaagaaagcuggacaagccaaaaaaaaaaaauaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10893 - protein, 1159 aa, Artificial Sequence
  Cas13a variant__Leptotrichia buccalis__WP_015770004.1__Cas13a
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10894 - protein, 1159 aa, Artificial Sequence
  Cas13a variant__Leptotrichia buccalis__WP_015770004.1__Cas13a(R472A,H477A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIAHGIVAFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10895 - protein, 1159 aa, Artificial Sequence
  Cas13a variant__Leptotrichia buccalis__WP_015770004.1__Cas13a(R1048A,H1053A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIANYIAAFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10896 - protein, 1159 aa, Artificial Sequence
  Cas13a variant__Leptotrichia buccalis__WP_015770004.1__Cas13a(R472A,H477A,R1048A,H1053A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIAHGIVAFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIANYIAAFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10897 - protein, 1159 aa, Artificial Sequence
  Cas13a variant__Leptotrichia buccalis__WP_015770004.1__Cas13a(R1079A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDAKLKNAVMKSVVDILKEYGFVATFKIGADKKIGIQTLESEKIVHLKNLKKKKLMTDRNSEELCKLVKIMFEYKMEEKKSEN

SEQ ID NO: 10898 - protein, 1159 aa, Artificial Sequence
  Cas13a variant__Leptotrichia buccalis__WP_015770004.1__Cas13a(E299A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIAMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10899 - protein, 1159 aa, Artificial Sequence
  Cas13a variant__Leptotrichia buccalis__WP_015770004.1__Cas13a(K310A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYARLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10900 - protein, 1159 aa, Artificial Sequence
  Cas13a variant__Leptotrichia buccalis__WP_015770004.1__Cas13a(N314A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSAISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10901 - protein, 1159 aa, Artificial Sequence
  Cas13a variant__Leptotrichia buccalis__WP_015770004.1__Cas13a(R1072A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLAKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 10902 - protein, 1159 aa, Artificial Sequence
  Cas13a variant__Leptotrichia buccalis__WP_015770004.1__Cas13a(D1078A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYARKLKNAVMKSVVDILKEYGFVATFKIGADKKIGIQTLESEKIVHLKNLKKKKLMTDRNSEELCKLVKIMFEYKMEEKKSEN

SEQ ID NO: 10903 - protein, 1159 aa, Artificial Sequence
  Cas13a variant__Leptotrichia buccalis__WP_015770004.1__Cas13a(R1079A,K1080A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDAALKNAVMKSVVDILKEYGFVATFKIGADKKIGIQTLESEKIVHLKNLKKKKLMTDRNSEELCKLVKIMFEYKMEEKKSEN

SEQ ID NO: 10904 - protein, 1159 aa, Artificial Sequence
  Cas13a variant__Leptotrichia buccalis__WP_015770004.1__Cas13a(K1080A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRALKNAVMKSVVDILKEYGFVATFKIGADKKIGIQTLESEKIVHLKNLKKKKLMTDRNSEELCKLVKIMFEYKMEEKKSEN

SEQ ID NO: 10905 - protein, 1159 aa, Artificial Sequence
  Cas13a variant__Leptotrichia buccalis__WP_015770004.1__Cas13a(K1082A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLANAVMKSVVDILKEYGFVATFKIGADKKIGIQTLESEKIVHLKNLKKKKLMTDRNSEELCKLVKIMFEYKMEEKKSEN

SEQ ID NO: 10906 - protein, 1159 aa, Artificial Sequence
  Cas13a variant__Leptotrichia buccalis__WP_015770004.1__Cas13a(K1087A)
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMASVVDILKEYGFVATFKIGADKKIGIQTLESEKIVHLKNLKKKKLMTDRNSEELCKLVKIMFEYKMEEKKSEN

SEQ ID NO: 10907 - protein, 1389 aa, Artificial Sequence
  Cas13a variant__Leptotrichia shahii__WP_018451595.1__Cas13a
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 10908 - protein, 1389 aa, Artificial Sequence; identical to SEQ ID NO: 10907
  Cas13a variant__Leptotrichia shahii__WP_018451595.1__Cas13a

SEQ ID NO: 10909 - protein, 1434 aa, Artificial Sequence
  Cas13a variant__Leptotrichia shahii__WP_018451595.1__Cas13a(long)
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 10910 - protein, 1385 aa, Artificial Sequence
  Cas13a variant__Leptotrichia sp. oral__WP_021744063.1__Cas13a
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 10911 - protein, 1152 aa, Artificial Sequence
  Cas13a variant__Leptotrichia wadei__WP_021746774.1__Cas13a
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10912 - protein, 1152 aa, Artificial Sequence
  Cas13a variant__Leptotrichia wadei__WP_021746774.1__Cas13a(G403D)
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10913 - protein, 1302 aa, Artificial Sequence
  Cas13a variant__Leptotrichia wadei__WP_021746774.1__6xHis-Tag/Twin-Strep/SUMO_Cas13a(G403D)
MGSSHHHHHHSSGLVPRGSHMASWSHPQFEKGGGSGGGSGGSAWSHPQFEKMSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGGSMKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10914 - protein, 1152 aa, Artificial Sequence
  Cas13a variant__Leptotrichia wadei__WP_021746774.1__Cas13a(R474A,R1046A)
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIAHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIANYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 10915 - protein, 1690 aa, Artificial Sequence
  Cas13a variant__Leptotrichia wadei__WP_021746774.1__XY_Cas13a(R474A,R1046A)_EGFP_ZF-CCR5T_KRAB -A _NLS
MGGEGLRASPRRRPLLPLQPRGCPRGDGCLRGGRGRAGFGFWRVTGGSRASANHVHAFFFFLQLLGNVLVIVLSHHFGKEFGTAGPGATMKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIAHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIANYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYSRGAGAGAGAGAGSRFQCRICMRNFSDRSNLSRHIRTHTGEKPFACDICGRKFAISSNLNSHTKIHTGSQKPFQCRICMRNFSRSDNLARHIRTHTGEKPFACDICGRKFATSGNLTRHTKIHLRGSQLSIVDAPEQREGASQVSVSVTFEDVAVLFTRDEWKKLDLSQRSLYREVMLENYSNLASMAGSPKKKRKV

SEQ ID NO: 10916 - protein, 1182 aa, Artificial Sequence
  Cas13a variant__Leptotrichia wadei__ERK53440.1__Cas13a
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 10917 - protein, 1385 aa, Artificial Sequence
  Cas13a variant__Clostridium aminophilum__WP_031473346.1__Cas13a
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 10918 - protein, 1344 aa, Artificial Sequence
  Cas13a variant__Eubacterium rectale strain__CVRQ01000008.1__Cas13a
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 10919 - protein, 1285 aa, Artificial Sequence
  Cas13a variant__Herbinix hemicellulosilytica__CRZ35554.1__Cas13a
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 10920 - protein, 1437 aa, Artificial Sequence
  Cas13a variant__Lachnospiraceae bacterium__WP_022785443.1__Cas13a
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 10921 - protein, 1051 aa, Artificial Sequence
  Cas13a variant__Listeria newyorkensis__WP_036091002.1__Cas13a
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 10922 - protein, 1120 aa, Artificial Sequence
  Cas13a variant__Listeria seeligeri__WP_012985477.1__Cas13a
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 10923 - protein, 1154 aa, Artificial Sequence
  Cas13a variant__Paludibacter propionicigenes__WP_013443710.1__Cas13a
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10924 - protein, 1285 aa, Artificial Sequence
  Cas13a variant__Rhodobacter capsulatus__ETD76934.1__Cas13a
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 10925 - protein, 525 aa, Artificial Sequence
  Cas13a variant__Corynebacterium ulcerans__WP_038617242.1__Cas13
MPKYCLTARFPLGVYLGHTGDANRDAYPDPARLHAALMNAAAQGVHAEEDPNEHQLRPSQQSLQALQWLEAHPPTGLAMPEQQWLSPDTSRMMYRNVGSVKIDKTGVTRATENRAVSDGVSVNGAYGYIWDEMPVDIAEAITALLPDVACLGEASSLVVLEQQEIEATLTLDPQATAFSTERVQVRIALPGRTQHLREVFHARYGKKPPSKKADKFLKDDPIHDPPIPKDHLGTARYLRVNAADKECVTPWTKVILLEVHGKQLGAKEQVRAAVALHRALIARIRTDVSPVITGRYAAGAQRPANNLAIQYIPHRHLEALGLKTSAFALLVPQDADSTVYEQLNQALTGPFPLRSGGKLLCQLKYNGHVFRGDAFWPAPQPGTIRMWEPLNVFIPESRPHNKQQGVLWRLADAGLLSVAFVWRDNFPTKETGPARYVELRDAAYNADVRIFHDHPVSRNTRRFVHRTNRSLTIQPWRGLVHLGSLQQDRAIIALGQSRHLGGGLLIPVDIPRSEFETMTSEMTHA

SEQ ID NO: 10926 - protein, 1224 aa, Artificial Sequence
  Cas13b variant__Bergeyella zoohelcum__WP_002664492.1__Cas13b
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 10927 - protein, 1224 aa, Artificial Sequence
  Cas13b variant__Bergeyella zoohelcum__WP_002664492.1__Cas13b(R116A,H121A,R1177A,H1182A)
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLANFYTAKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIANKFAANQLPKKEFWDYCQEKYGKIEKEKTYAEYFAEVFKKEKEALIK

SEQ ID NO: 10928 - protein, 1127 aa, Artificial Sequence
  Cas13b variant__Prevotella buccae__WP_004343973.1__Cas13b
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 10929 - protein, 1090 aa, Artificial Sequence
  Cas13b variant__Prevotella sp.__WP_044065294__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 10930 - protein, 1383 aa, Artificial Sequence
  Cas13b variant__Artificial____PspCas13b-GS-HsADAR2DD(E488Q,del984-1090)
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDGSLQLPPLERLTLGSQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT

SEQ ID NO: 10931 - protein, 1383 aa, Artificial Sequence
  Cas13b variant__Artificial____PspCas13b-GS-HsADAR2DD(E488Q,T375G,del984- 1090)
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNAYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDGSLQLPPLERLTLGSQLHLPQVLADAVSRLVLGKFGDLTDNFSSPHARRKVLAGVVMTTGTDVKDAKVISVSTGGKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT

SEQ ID NO: 10932 - protein, 953 aa, Artificial Sequence
  Cas13b variant__Alistipes sp.__WP_047447901.1__Cas13b
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 10933 - protein, 1115 aa, Artificial Sequence
  Cas13b variant__Bacteroides pyogenes__ERI81700.1__Cas13b
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 10934 - protein, 1115 aa, Artificial Sequence
  Cas13b variant__Bacteroides pyogenes__WP_034542281.1__Cas13b
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 10935 - protein, 1224 aa, Artificial Sequence; identical to SEQ ID NO: 10926
  Cas13b variant__Bergeyella zoohelcum__WP_002664492.1__Cas13b

SEQ ID NO: 10936 - protein, 1199 aa, Artificial Sequence
  Cas13b variant__Capnocytophaga canimorsus__WP_013997271.1__Cas13b
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 10937 - protein, 1218 aa, Artificial Sequence
  Cas13b variant__Capnocytophaga cynodegmi__WP_041989581.1__Cas13b
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 10938 - protein, 1145 aa, Artificial Sequence
  Cas13b variant__Chryseobacterium sp.__WP_047431796.1__Cas13b
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 10939 - protein, 1150 aa, Artificial Sequence
  Cas13b variant__Flavobacterium branchiophilum__WP_014084666.1__Cas13b
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 10940 - protein, 1213 aa, Artificial Sequence
  Cas13b variant__Flavobacterium columnare__WP_060381855.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 10941 - protein, 1179 aa, Artificial Sequence
  Cas13b variant__Flavobacterium columnare__WP_014165541.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 10942 - protein, 1213 aa, Artificial Sequence
  Cas13b variant__Flavobacterium columnare__WP_063744070.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 10943 - protein, 1214 aa, Artificial Sequence
  Cas13b variant__Flavobacterium columnare__WP_065213424.1__Cas13b
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 10944 - protein, 1155 aa, Artificial Sequence
  Cas13b variant__Flavobacterium sp.__WP_045968377.1__Cas13b
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 10945 - protein, 1159 aa, Artificial Sequence
  Cas13b variant__Myroides odoratimimus__EHO06562.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 10946 - protein, 1157 aa, Artificial Sequence
  Cas13b variant__Myroides odoratimimus__WP_006261414.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 10947 - protein, 1157 aa, Artificial Sequence
  Cas13b variant__Myroides odoratimimus__EKB06014.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 10948 - protein, 1159 aa, Artificial Sequence
  Cas13b variant__Myroides odoratimimus__WP_058700060.1__Cas13b
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 10949 - protein, 1154 aa, Artificial Sequence
  Cas13b variant__Paludibacter propionicigenes__WP_013446107.1__Cas13b
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 10950 - protein, 1131 aa, Artificial Sequence
  Cas13b variant__Phaeodactylibacter xiamenensis__WP_044218239.1__Cas13b
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 10951 - protein, 1135 aa, Artificial Sequence
  Cas13b variant__Porohyromonas gingivalis__WP_012458151.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10952 - protein, 1135 aa, Artificial Sequence
  Cas13b variant__Porohyromonas gingivalis__ERJ81987.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 10953 - protein, 1135 aa, Artificial Sequence
  Cas13b variant__Porohyromonas gingivalis__ERJ65637.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10954 - protein, 1135 aa, Artificial Sequence
  Cas13b variant__Porohyromonas gingivalis__WP_021665475.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 10955 - protein, 1135 aa, Artificial Sequence
  Cas13b variant__Porohyromonas gingivalis__WP_061156637.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10956 - protein, 1135 aa, Artificial Sequence
  Cas13b variant__Porohyromonas gingivalis__WP_023846767.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10957 - protein, 1135 aa, Artificial Sequence
  Cas13b variant__Porohyromonas gingivalis__ERJ87335.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 10958 - protein, 1135 aa, Artificial Sequence
  Cas13b variant__Porohyromonas gingivalis__WP_005873511.1__Cas13b
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 10959 - protein, 1135 aa, Artificial Sequence
  Cas13b variant__Porohyromonas gulae__WP_039445055.1__Cas13b
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 10960 - protein, 1175 aa, Artificial Sequence
  Cas13b variant__Porphyromonas gingivalis__WP_052912312.1__Cas13b
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 10961 - protein, 1119 aa, Artificial Sequence
  Cas13b variant__Porphyromonas gingivalis__WP_053444417.1__Cas13b
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 10962 - protein, 1119 aa, Artificial Sequence
  Cas13b variant__Porphyromonas gingivalis__WP_012458414.1__Cas13b
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 10963 - protein, 1119 aa, Artificial Sequence
  Cas13b variant__Porphyromonas gingivalis__WP_039417390.1__Cas13b
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 10964 - protein, 1175 aa, Artificial Sequence
  Cas13b variant__Porphyromonas gingivalis__EOA10535.1__Cas13b
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 10965 - protein, 1119 aa, Artificial Sequence
  Cas13b variant__Porphyromonas gingivalis__WP_061156470.1__Cas13b
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 10966 - protein, 1119 aa, Artificial Sequence
  Cas13b variant__Porphyromonas gingivalis__WP_013816155.1__Cas13b
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 10967 - protein, 1175 aa, Artificial Sequence
  Cas13b variant__Porphyromonas gingivalis__WP_005874195.1__Cas13b
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 10968 - protein, 1119 aa, Artificial Sequence
  Cas13b variant__Porphyromonas gulae__WP_039437199.1__Cas13b
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 10969 - protein, 1119 aa, Artificial Sequence
  Cas13b variant__Porphyromonas gulae__WP_039419792.1__Cas13b
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10970 - protein, 1175 aa, Artificial Sequence
  Cas13b variant__Porphyromonas gulae__WP_039431778.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 10971 - protein, 1175 aa, Artificial Sequence
  Cas13b variant__Porphyromonas gulae__WP_046201018.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 10972 - protein, 1174 aa, Artificial Sequence
  Cas13b variant__Porphyromonas gulae__WP_039442171.1__Cas13b
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10973 - protein, 1119 aa, Artificial Sequence
  Cas13b variant__Porphyromonas gulae__WP_039426176.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 10974 - protein, 1175 aa, Artificial Sequence
  Cas13b variant__Porphyromonas gulae__WP_039418912.1__Cas13b
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10975 - protein, 1175 aa, Artificial Sequence
  Cas13b variant__Porphyromonas gulae__WP_039434803.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10976 - protein, 1175 aa, Artificial Sequence
  Cas13b variant__Porphyromonas sp.__WP_039428968.1__Cas13b
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 10977 - protein, 1124 aa, Artificial Sequence
  Cas13b variant__Prevotella aurantiaca__WP_025000926.1__Cas13b
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 10978 - protein, 1127 aa, Artificial Sequence; identical to SEQ ID NO: 10928
  Cas13b variant__Prevotella buccae__EFU31981.1__Cas13b

SEQ ID NO: 10979 - protein, 1127 aa, Artificial Sequence
  Cas13b variant__Prevotella buccae__WP_004343581.1__Cas13b
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 10980 - protein, 1133 aa, Artificial Sequence
  Cas13b variant__Prevotella falsenii__WP_036884929.1__Cas13b
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 10981 - protein, 1133 aa, Artificial Sequence
  Cas13b variant__Prevotella intermedia__BAU18623.1__Cas13b
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 10982 - protein, 1134 aa, Artificial Sequence
  Cas13b variant__Prevotella intermedia__AFJ07523.1__Cas13b
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 10983 - protein, 1132 aa, Artificial Sequence
  Cas13b variant__Prevotella intermedia__WP_014708441.1__Cas13b
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 10984 - protein, 1126 aa, Artificial Sequence
  Cas13b variant__Prevotella intermedia__WP_036860899.1__Cas13b
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 10985 - protein, 1120 aa, Artificial Sequence
  Cas13b variant__Prevotella intermedia__WP_061868553.1__Cas13b
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 10986 - protein, 1125 aa, Artificial Sequence
  Cas13b variant__Prevotella intermedia__KJJ86756.1__Cas13b
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 10987 - protein, 1125 aa, Artificial Sequence
  Cas13b variant__Prevotella pallens__EGQ18444.1__Cas13b
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 10988 - protein, 1150 aa, Artificial Sequence
  Cas13b variant__Prevotella saccharolytica__EKY00089.1__Cas13b
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 10989 - protein, 1322 aa, Artificial Sequence
  Cas13b variant__Prevotella sp.__WP_036929175.1__Cas13b
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 10990 - protein, 1127 aa, Artificial Sequence
  Cas13b variant__Prevotella sp.__WP_007412163.1__Cas13b
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 10991 - protein, 1090 aa, Artificial Sequence
  Cas13b variant__Prevotella sp.__WP_044072147.1__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 10992 - protein, 1090 aa, Artificial Sequence
  Cas13b variant__Prevotella sp.__WP_042518169.1__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 10993 - protein, 1090 aa, Artificial Sequence
  Cas13b variant__Prevotella sp.__WP_044074780.1__Cas13b
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 10994 - protein, 1145 aa, Artificial Sequence
  Cas13b variant__Psychroflexus torquis__WP_015024765.1__Cas13b
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 10995 - protein, 948 aa, Artificial Sequence
  Cas13b variant__Riemerella anatipestifer__WP_049354263.1__Cas13b
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 10996 - protein, 1095 aa, Artificial Sequence
  Cas13b variant__Riemerella anatipestifer__WP_004919755.1__Cas13b
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 10997 - protein, 1095 aa, Artificial Sequence
  Cas13b variant__Riemerella anatipestifer__WP_064970887.1__Cas13b
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 10998 - protein, 950 aa, Artificial Sequence
  Cas13b variant__Riemerella anatipestifer__WP_061710138.1__Cas13b
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 10999 - protein, 949 aa, Artificial Sequence
  ARMAN Cas9 variant__Candidatus Micrarchaeum acidiphilum__OJI07263.1__Cas9
MRDSITAPRYSSALAARIKEFNSAFKLGIDLGTKTGGVALVKDNKVLLAKTFLDYHKQTLEERRIHRRNRRSRLARRKRIARLRSWILRQKIYGKQLPDPYKIKKMQLPNGVRKGENWIDLVVSGRDLSPEAFVRAITLIFQKRGQRYEEVAKEIEEMSYKEFSTHIKALTSVTEEEFTALAAEIERRQDVVDTDKEAERYTQLSELLSKVSESKSESKDRAQRKEDLGKVVNAFCSAHRIEDKDKWCKELMKLLDRPVRHARFLNKVLIRCNICDRATPKKSRPDVRELLYFDTVRNFLKAGRVEQNPDVISYYKKIYMDAEVIRVKILNKEKLTDEDKKQKRKLASELNRYKNKEYVTDAQKKMQEQLKTLLFMKLTGRSRYCMAHLKERAAGKDVEEGLHGVVQKRHDRNIAQRNHDLRVINLIESLLFDQNKSLSDAIRKNGLMYVTIEAPEPKTKHAKKGAAVVRDPRKLKEKLFDDQNGVCIYTGLQLDKLEISKYEKDHIFPDSRDGPSIRDNLVLTTKEINSDKGDRTPWEWMHDNPEKWKAFERRVAEFYKKGRINERKRELLLNKGTEYPGDNPTELARGGARVNNFITEFNDRLKTHGVQELQTIFERNKPIVQVVRGEETQRLRRQWNALNQNFIPLKDRAMSFNHAEDAAIAASMPPKFWREQIYRTAWHFGPSGNERPDFALAELAPQWNDFFMTKGGPIIAVLGKTKYSWKHSIIDDTIYKPFSKSAYYVGIYKKPNAITSNAIKVLRPKLLNGEHTMSKNAKYYHQKIGNERFLMKSQKGGSIITVKPHDGPEKVLQISPTYECAVLTKHDGKIIVKFKPIKPLRDMYARGVIKAMDKELETSLSSMSKHAKYKELHTHDIIYLPATKKHVDGYFIITKLSAKHGIKALPESMVKVKYTQIGSENNSEVKLTKPKPEITLDSEDITNIYNFTR

SEQ ID NO: 11000 - protein, 967 aa, Artificial Sequence
  ARMAN Cas9 variant__Candidatus Parvarchaeum acidiphilum__APG80630.1__Cas9
MLGSSRYLRYNLTSFEGKEPFLIMGYYKEYNKELSSKAQKEFNDQISEFNSYYKLGIDLGDKTGIAIVKGNKIILAKTLIDLHSQKLDKRREARRNRRTRLSRKKRLARLRSWVMRQKVGNQRLPDPYKIMHDNKYWSIYNKSNSANKKNWIDLLIHSNSLSADDFVRGLTIIFRKRGYLAFKYLSRLSDKEFEKYIDNLKPPISKYEYDEDLEELSSRVENGEIEEKKFEGLKNKLDKIDKESKDFQVKQREEVKKELEDLVDLFAKSVDNKIDKARWKRELNNLLDKKVRKIRFDNRFILKCKIKGCNKNTPKKEKVRDFELKMVLNNARSDYQISDEDLNSFRNEVINIFQKKENLKKGELKGVTIEDLRKQLNKTFNKAKIKKGIREQIRSIVFEKISGRSKFCKEHLKEFSEKPAPSDRINYGVNSAREQHDFRVLNFIDKKIFKDKLIDPSKLRYITIESPEPETEKLEKGQISEKSFETLKEKLAKETGGIDIYTGEKLKKDFEIEHIFPRARMGPSIRENEVASNLETNKEKADRTPWEWFGQDEKRWSEFEKRVNSLYSKKKISERKREILLNKSNEYPGLNPTELSRIPSTLSDFVESIRKMFVKYGYEEPQTLVQKGKPIIQVVRGRDTQALRWRWHALDSNIIPEKDRKSSFNHAEDAVIAACMPPYYLRQKIFREEAKIKRKVSNKEKEVTRPDMPTKKIAPNWSEFMKTRNEPVIEVIGKVKPSWKNSIMDQTFYKYLLKPFKDNLIKIPNVKNTYKWIGVNGQTDSLSLPSKVLSISNKKVDSSTVLLVHDKKGGKRNWVPKSIGGLLVYITPKDGPKRIVQVKPATQGLLIYRNEDGRVDAVREFINPVIEMYNNGKLAFVEKENEEELLKYFNLLEKGQKFERIRRYDMITYNSKFYYVTKINKNHRVTIQEESKIKAESDKVKSSSGKEYTRKETEELSLQKLAELISI

SEQ ID NO: 11001 - protein, 949 aa, Artificial Sequence
  ARMAN Cas9 variant__Candidatus Micrarchaeum sp.__OJT94500.1__Cas9
MRDSITAPRYSSALAARIKEFNSAFKLGIDLGTKTGGVALVKDNKVLLAKTFLDYHKQTLEERRIHRRNRRSRLARRKRIARLRSWILRQKIYGKQLPDPYKIKKMQLPNGVRKGENWIDLVVSGRDLSPEAFVRAITLIFQKRGQRYEEVAKEIEEMSYKEFSTHIKALTSVTEEEFTALAAEIERRQDVVDTDKEAERYTQLSELLSKVSESKSESKDRAQRKEDLGKVVNAFCSAHRIEDKDKWCKELMKLLDRPVRHARFLNKVLIRCNICDRATPKKSRPDVRELLYFDTVRNFLKAGRVEQNPDVISYYKKIYMDAEVIRVKILNKEKLTDEDKKQKRKLASELNRYKNKEYVTDAQKKMQEQLKTLLFMKLTGRSRYCMAHLKERAAGKDVEEGLHGVVQKRHDRNIAQRNHDLRVINLIESLLFDPNKSLSDAIRKNGLMYVTIEAPEPKTKHAKKGAAVVRDPRKLKEKLFDDQNGVCIYTGLQLDKLEISKYEKDHIFPDSRDGPSIRDNLVLTTKEINSDKGDRTPWEWMHDNPEKWKAFERRVAEFYKKGRINERKRELLLNKGTEYPGDNPTELARGGARVNNFITEFNDRLKTHGVQELQTIFERNKPIVQVVRGEETQRLRRQWNALNQNFIPLKDRAMSFNHAEDAAIAASMPPKFWREQIYRTAWHFGPSGNERPDFALAELAPQWNDFFMTKGGPIIAVLGKTKYSWKHSIIDDTIYKPFSKSAYYVGIYKKPNAITSNAIKVLRPKLLNGEHTMSKNAKYYHQKIGNERFLMKSQKGGSIITVKPHDGPEKVLQISPTYECAVLTKHDGKIIVKFKPIKPLRDMYARGVIKAMDKELETSLSSMSKHAKYKELHTHDIIYLPATKKHVDGYFIITKLSAKHGIKALPESMVKVKYTQIGSENNSEVKLTKPKPEITLDSEDITNIYNFTR

SEQ ID NO: 11002 - protein, 986 aa, Artificial Sequence
  CasX variant__Deltaproteobacteria bacterium__OGP07438.1__CasX
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 11003 - protein, 978 aa, Artificial Sequence
  CasX variant__Planctomycetes bacterium__OHB99618.1__CasX
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 11004 - protein, 1125 aa, Artificial Sequence
  CasY variant__Candidatus Katanobacteria bacterium__OJI08769.1__CasY
MRKKLFKGYILHNKRLVYTGKAAIRSIKYPLVAPNKTALNNLSEKIIYDYEHLFGPLNVASYARNSNRYSLVDFWIDSLRAGVIWQSKSTSLIDLISKLEGSKSPSEKIFEQIDFELKNKLDKEQFKDIILLNTGIRSSSNVRSLRGRFLKCFKEEFRDTEEVIACVDKWSKDLIVEGKSILVSKQFLYWEEEFGIKIFPHFKDNHDLPKLTFFVEPSLEFSPHLPLANCLERLKKFDISRESLLGLDNNFSAFSNYFNELFNLLSRGEIKKIVTAVLAVSKSWENEPELEKRLHFLSEKAKLLGYPKLTSSWADYRMIIGGKIKSWHSNYTEQLIKVREDLKKHQIALDKLQEDLKKVVDSSLREQIEAQREALLPLLDTMLKEKDFSDDLELYRFILSDFKSLLNGSYQRYIQTEEERKEDRDVTKKYKDLYSNLRNIPRFFGESKKEQFNKFINKSLPTIDVGLKILEDIRNALETVSVRKPPSITEEYVTKQLEKLSRKYKINAFNSNRFKQITEQVLRKYNNGELPKISEVFYRYPRESHVAIRILPVKISNPRKDISYLLDKYQISPDWKNSNPGEVVDLIEIYKLTLGWLLSCNKDFSMDFSSYDLKLFPEAASLIKNFGSCLSGYYLSKMIFNCITSEIKGMITLYTRDKFVVRYVTQMIGSNQKFPLLCLVGEKQTKNFSRNWGVLIEEKGDLGEEKNQEKCLIFKDKTDFAKAKEVEIFKNNIWRIRTSKYQIQFLNRLFKKTKEWDLMNLVLSEPSLVLEEEWGVSWDKDKLLPLLKKEKSCEERLYYSLPLNLVPATDYKEQSAEIEQRNTYLGLDVGEFGVAYAVVRIVRDRIELLSWGFLKDPALRKIRERVQDMKKKQVMAVFSSSSTAVARVREMAIHSLRNQIHSIALAYKAKIIYEISISNFETGGNRMAKIYRSIKVSDVYRESGADTLVSEMIWGKKNKQMGNHISSYATSYTCCNCARTPFELVIDNDKEYEKGGDEFIFNVGDEKKVRGFLQKSLLGKTIKGKEVLKSIKEYARPPIREVLLEGEDVEQLLKRRGNSYIYRCPFCGYKTDADIQAALNIACRGYISDNAKDAVKEGERKLDYILEVRKLWEKNGAVLRSAKFL

SEQ ID NO: 11005 - protein, 1287 aa, Artificial Sequence
  CasY variant__Candidatus Kerfeldbacteria bacterium__OGY82221.1__CasY
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 11006 - protein, 1192 aa, Artificial Sequence
  CasY variant__Candidatus Komeilibacteria bacterium__OJI06454.1__CasY
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDRGVAEKIEQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPAGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWSTYWEKRKPEDILGISTQVYWTGGIGESCPAVAVALLGHIRATSTQTEWEKEEVVFGRLKKFFPS

SEQ ID NO: 11007 - protein, 1210 aa, Artificial Sequence
  CasY variant__Candidatus Parcubacteria bacterium__APG80656.1__CasY
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 11008 - protein, 1226 aa, Artificial Sequence
  CasY variant__Candidatus Vogelbacteria bacterium__OJI07455.1__CasY
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKCRHISDADIQASYWIALKQVVRDFYKDKEMDGDLIQGDNKDKRKVNELNRLIGVHKDVPIINKNLITSLDINLL

SEQ ID NO: 11009 - protein, 1200 aa, Artificial Sequence
  CasY variant__Candidatus Vogelbacteria bacterium__OJI09436.1__CasY
MKAKKSFYNQKRKFGKRGYRLHDERIAYSGGIGSMRSIKYELKDSYGIAGLRNRIADATISDNKWLYGNINLNDYLEWRSSKTDKQIEDGDRESSLLGFWLEALRLGFVFSKQSHAPNDFNETALQDLFETLDDDLKHVLDRKKWCDFIKIGTPKTNDQGRLKKQIKNLLKGNKREEIEKTLNESDDELKEKINRIADVFAKNKSDKYTIFKLDKPNTEKYPRINDVQVAFFCHPDFEEITERDRTKTLDLIINRFNKRYEITENKKDDKTSNRMALYSLNQGYIPRVLNDLFLFVKDNEDDFSQFLSDLENFFSFSNEQIKIIKERLKKLKKYAEPIPGKPQLADKWDDYASDFGGKLESWYSNRIEKLKKIPESVSDLRNNLEKIRNVLKKQNNASKILELSQKIIEYIRDYGVSFEKPEIIKFSWINKTKDGQKKVFYVAKMADREFIEKLDLWMADLRSQLNEYNQDNKVSFKKKGKKIEELGVLDFALNKAKKNKSTKNENGWQQKLSESIQSAPLFFGEGNRVRNEEVYNLKDLLFSEIKNVENILMSSEAEDLKNIKIEYKEDGAKKGNYVLNVLARFYARFNEDGYGGWNKVKTVLENIAREAGTDFSKYGNNNNRNAGRFYLNGRERQVFTLIKFEKSITVEKILELVKLPSLLDEAYRDLVNENKNHKLRDVIQLSKTIMALVLSHSDKEKQIGGNYIHSKLSGYNALISKRDFISRYSVQTTNGTQCKLAIGKGKSKKGNEIDRYFYAFQFFKNDDSKINLKVIKNNSHKNIDFNDNENKINALQVYSSNYQIQFLDWFFEKHQGKKTSLEVGGSFTIAEKSLTIDWSGSNPRVGFKRSDTEEKRVFVSQPFTLIPDDEDKERRKERMIKTKNRFIGIDIGEYGLAWSLIEVDNGDKNNRGIRQLESGFITDNQQQVLKKNVKSWRQNQIRQTFTSPDTKIARLRESLIGSYKNQLESLMVAKKANLSFEYEVSGFEVGGKRVAKIYDSIKRGSVRKKDNNSQNDQSWGKKGINEWSFETTAAGTSQFCTHCKRWSSLAIVDIEEYELKDYNDNLFKVKINDGEVRLLGKKGWRSGEKIKGKELFGPVKDAMRPNVDGLGMKIVKRKYLKLDLRDWVSRYGNMAIFICPYVDCHHISHADKQAAFNIAVRGYLKSVNPDRAIKHGDKGLSRDFLCQEEGKLNFEQIGLL

SEQ ID NO: 11010 - protein, 1153 aa, Artificial Sequence
  CasY variant__Candidatus Vogelbacteria bacterium__PIP58309.1__CasY
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKC

SEQ ID NO: 11011 - RNA, 3480 nt, Artificial Sequence
  Cas13a variant__Leptotrichia buccalis__WP_015770004.1__Cas13a
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11012 - RNA, 3480 nt, Artificial Sequence
  Cas13a variant__Leptotrichia buccalis__WP_015770004.1__Cas13a(R472A,H477A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccaucgcucacgguauugucgccuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11013 - RNA, 3480 nt, Artificial Sequence
  Cas13a variant__Leptotrichia buccalis__WP_015770004.1__Cas13a(R1048A,H1053A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauugcuaauuacaucgccgcauucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11014 - RNA, 3480 nt, Artificial Sequence
  Cas13a variant__Leptotrichia buccalis__WP_015770004.1__Cas13a(R472A,H477A,R1048A,H1053A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccaucgcucacgguauugucgccuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauugcuaauuacaucgccgcauucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11015 - RNA, 3480 nt, Artificial Sequence
  Cas13a variant__Leptotrichia buccalis__WP_015770004.1__Cas13a(R1079A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgcaauuacaucgcccacuucaauuauauuccucacgccgagaucucacugcuggaaguccuugaaaauuugcguaaauugcuguccuacgaugccaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11016 - RNA, 3480 nt, Artificial Sequence
  Cas13a variant__Leptotrichia buccalis__WP_015770004.1__Cas13a(E299A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgccaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11017 - RNA, 3480 nt, Artificial Sequence
  Cas13a variant__Leptotrichia buccalis__WP_015770004.1__Cas13a(K310A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauaugcccgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11018 - RNA, 3480 nt, Artificial Sequence
  Cas13a variant__Leptotrichia buccalis__WP_015770004.1__Cas13a(N314A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaagugcaaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgcaauuacaucgcccacuucaauuauauuccucacgccgagaucucacugcuggaaguccuugaaaauuugcguaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11019 - RNA, 3480 nt, Artificial Sequence
  Cas13a variant__Leptotrichia buccalis__WP_015770004.1__Cas13a(R1072A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuuggcaaaauugcuguccuacgaucgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11020 - RNA, 3480 nt, Artificial Sequence
  Cas13a variant__Leptotrichia buccalis__WP_015770004.1__Cas13a(D1078A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgcacgcaaacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11021 - RNA, 3480 nt, Artificial Sequence
  Cas13a variant__Leptotrichia buccalis__WP_015770004.1__Cas13a(R1079A,K1080A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaugccgcacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11022 - RNA, 3480 nt, Artificial Sequence
  Cas13a variant__Leptotrichia buccalis__WP_015770004.1__Cas13a(K1080A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcgcacugaaaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11023 - RNA, 3480 nt, Artificial Sequence
  Cas13a variant__Leptotrichia buccalis__WP_015770004.1__Cas13a(K1082A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcaaacuggcaaaugccguaaugaaaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11024 - RNA, 3480 nt, Artificial Sequence
  Cas13a variant__Leptotrichia buccalis__WP_015770004.1__Cas13a(K1087A)
augaaagugacgaagguaggaggcauuucgcauaagaaguacacguccgaaggccgcuuagugaagucagaaucggaagaaaaucgcacagacgaacgucugucggcguugcuuaauaugcgccuugacauguauaucaagaaucccagcagcacggaaaccaaggaaaaucaaaaacgcauugggaaauuaaagaaauucuucucaaacaaaauggucuaucuuaaagacaauaccuugaguuugaagaaugggaaaaaggagaacauugaucgugaguauucugagacugacauccuugagagcgauguccgugacaagaaaaacuucgccguguugaaaaagaucuaucugaaugaaaacgugaacucggaggaauuggaaguuuuucguaacgacauuaagaagaaacugaacaaaaucaacagccugaaguacucauuugaaaagaauaaggcgaauuaucaaaagauuaaugagaauaacaucgagaagguugaagguaagucaaagcguaacauuauuuacgauuauuaucgugagucagcgaaacgugacgcuuauguaagcaaugugaaagaagccuuugauaagcuuuacaaggaagaggacauugcaaaacuuguucuugaaauugagaaccuuacgaaguuagagaaauacaagauucgcgaguucuaccacgaaauuauuggacguaagaaugacaaggaaaacuuugcaaaaaucaucuacgaagaaauccagaauguuaauaacaugaaagaguugaucgagaagguaccggacaugagugaguugaaaaagagccaaguauuuuacaaguauuacuuagacaaagaagaguugaacgacaagaacaucaaauacgcguuuugucauuucguggaaaucgaaaugagucaguugcugaagaacuacguauauaagcgcuuaaguaauaucucgaaugacaaaauuaagcguaucuuugaauaccagaacuugaaaaaauugaucgaaaauaagcuguuaaacaaacuugacacguacguccguaauuguggaaaguauaauuauuauuugcaagacggcgaaauugccacuucagauuucaucgcccgcaaccgucagaaugaagcguuucuucgcaacaucauuggggugucaucuguggccuacuuuucucuucgcaacauucuugaaacggagaacgagaaugauauuacugggcguaugcgcggcaaaacaguuaagaacaauaaaggugaagagaaguacguguccggagaaguugauaagaucuauaaugaaaauaagaagaacgagguuaaggagaacuuaaaaauguucuauucguacgauuucaauauggacaacaagaaugaaaucgaagauuucuucgccaacaucgacgaggcgauuucuuccauccgucacgguauuguccacuucaacuuggaauuagaagguaaggauaucuuugcguucaagaacauugcgccauccgaaaucucaaagaagauguuucagaaugagauuaacgagaaaaaacugaaauugaagaucuuucgucaacugaacucugccaacguguuccgcuaucucgaaaaguauaaaauucugaauuaccuuaaacguacacgcuucgaguuugucaauaaaaauaucccauucgucccgucuuucaccaaauuauauucgcgcauugaugaccugaagaauagucuugggauuuacuggaaaacuccgaaaacaaacgacgacaauaagacuaaggagauuauugaugcccaaaucuauuugcuuaaaaacaucuauuacggggaguuccugaauuauuucaugucgaacaaugguaauuucuuugagauuucuaaagaaaucaucgaauugaacaagaacgauaaacgcaacuuaaagacuggguuuuacaagcugcaaaaguuugaagacauccaggagaagauuccaaaggaauacuuggcgaauauccagucccuguacaugauuaaugccgguaaucaggacgaagaagaaaaggacacuuauauugauuucauucaaaagaucuucuuaaagggauuuaugacguaucuugcuaauaacggucguuuaagucugauuuacaucggcucggaugaagaaacaaauacgucauuagcagaaaagaagcaagaguuugacaaguucuugaagaaguacgagcagaacaauaauaucaagauccccuaugagaucaaugaauuccugcgugagaucaaacugggaaacauccugaaguauacugagcguuuaaacauguucuaccuuaucuuaaagcuuuugaaucacaaggagcugacaaaucugaaggguagucuugaaaaauaucagucugccaauaaggaagaagcguucucugaccaauuggaguuaauuaaccugcuuaaccuugacaacaaccgcgugacggaagacuucgaauuagaggccgacgagauuggaaaauuucuugauuucaauggcaacaaaguuaaggauaacaaggaacugaaaaaguucgauacaaacaagaucuacuuugacggcgagaacauuaucaaacaccgugccuucuacaauauuaagaaauauggcauguuaaacuuacuggagaaaauugccgacaaggcuggauacaagaucucgaucgaagagcugaagaaauacuccaauaaaaagaaugagaucgagaagaaccauaagaugcaggaaaaucugcaccgcaaauacgcucguccccguaaagacgagaaguuuacagaugaggacuaugaaaguuacaagcaagcuauugagaauauugaggaguacacccaccuuaagaacaagguagaauucaaugagcugaauuuacugcagggccuguugcugcgcauuuuacaucguuuagucggauauaccucaauuugggaacgcgaucugcgcuuccgccuuaaaggugaguucccagaaaaccaauacaucgaagagaucuucaacuuugaaaauaagaagaacgugaaguacaaagggggucagauuguagagaaauacauuaaauucuacaaggaauuacaucaaaaugaugaaguuaagaucaacaaguacaguuccgcgaauaucaagguguugaagcaagaaaagaaggaccuuuauauucgaaauuacaucgcccacuucaauuauauuccucacgccgagaucucacugcuggaaguccuugaaaauuugcguaaauugcuguccuacgaucgcaaacugaaaaaugccguaauggcaucaguaguugauauccuuaaggaguaugguuuuguagccacauucaaaaucggggcggacaagaagaucgguauucagacacuggagagcgaaaaaaucgugcaucuuaagaaucuuaagaagaagaaguuaaugacugaccgcaauuccgaggaacuuugcaaauuggugaagauuauguuugaauacaaaauggaagagaaaaagucugaaaacuaa

SEQ ID NO: 11025 - RNA, 4170 nt, Artificial Sequence
  Cas13a variant__Leptotrichia shahii__WP_018451595.1__Cas13a
auggggaaccuuuucgggcauaaacgcugguacgaggugcgcgauaagaaggacuuuaagaucaaacgcaaagucaagguuaagcguaauuacgacgguaacaaauacaucuuaaacaucaacgagaacaacaauaaggagaaaaucgacaauaacaaguuuauucguaaguacaucaauuacaagaaaaacgacaauauccuuaaagaauuuacgcgcaaauuccaugcaggcaauaucuuguucaaguuaaaggguaaggaggggaucauucguaucgagaacaaugaugacuuucuggaaacugaagagguuguccuuuacaucgaagcguaugggaagagcgagaagcugaaagcucugggaaucacuaaaaaaaaaaucauugacgaggcgauucgucaaggcaucacaaaggaugacaagaaaaucgaaaucaagcgccaagagaacgaagaagaaaucgaaaucgacauccgcgaugaauacaccaacaagaccuuaaaugauugcaguauuauucugcgcaucauugaaaacgaugagcuugagacgaaaaagucuaucuaugagaucuuuaagaauaucaacaugucguuguacaagauuaucgagaagauuauugaaaaugagacugagaaagucuuugaaaaccguuauuaugaagagcaccuucgcgaaaaacugcuuaaggacgacaaaauugauguuauucugacuaacuuuauggagauucgugagaagaucaagagcaaccuggaaauuuuaggguucgucaaauucuacuuaaacguagggggggauaaaaagaaguccaaaaacaagaagauguugguggagaaaaucuuaaacaucaauguagaccugaccguggaggacauugcugauuuuguuauuaaggaguuggaguuuuggaacaucacaaaacgcauugaaaaaguuaagaaaguuaauaacgaguuuuuagaaaagcgucgcaaccgcacguauaucaaaucauacguccuuuuagauaagcacgaaaaauuuaagaucgagcgcgaaaacaagaaagauaaaauugucaaauuuuucgucgagaauaucaagaacaauagcaucaaggagaagaucgaaaagaucuuggcggaauuuaaaaucgacgaauugaucaaaaaauuagagaaagaguuaaagaaagguaacugcgauacagagaucuucgguaucuucaagaaacacuauaaggucaauuuugacuccaagaaguucuccaagaaaucugacgaggaaaaggaauuguauaagauuaucuaucgcuaccuuaaaggacgcaucgagaagauucuggucaacgaacagaagguacgcuuaaagaagauggagaaaaucgaaauugagaagauuuuaaacgaaucuauccuuucggaaaaaauccuuaagcgcgucaagcaguacacccuggaacacaucauguacuugggaaaacuucgucauaaugauauugauaugacgacugucaauacugaugauuuuucucgcuuacaugcgaaagaagagcuggacuuggaguugauuacguuuuucgcaucuacgaacauggaacugaacaagauuuucucucgcgagaauauuaauaacgacgaaaauauugacuucuuuggaggugaccgcgaaaagaacuaugugcucgacaagaaaauucucaacucuaagauuaagaucauucgcgaucuugauuucaucgacaauaagaacaacauuacgaauaacuuuauucgcaaguuuaccaagauugguacgaaugagcgcaaucguauuuugcacgccauuaguaaagaacgugauuugcagggaacgcaagacgacuauaacaagguaaucaacaucauucaaaacuugaagaucuccgacgaagaaguaucaaaagccuugaauuuggaugucguguucaaggauaagaagaacauuaucacaaaaaucaacgauauuaaaaucagugaggagaauaacaacgauauuaaauauuuaccgaguuuuagcaagguucugccggaaaucuuaaauuuauaccgcaauaauccuaaaaacgaacccuucgauacaauugagacugaaaagaucguguugaacgcucuuauuuaugugaacaaagaauuguacaagaaguuaauccuggaggaugaccuggaagagaacgagagcaaaaacauuuucuugcaggagcugaagaaaaccuuagguaauauugaugagaucgacgagaacaucauugagaauuacuacaagaacgcccaaaucucggcgucuaaaggaaauaauaaggcgauuaagaaauaccagaagaaaguuaucgaaugcuacaucggguauuugcguaagaacuacgaagagcuuuucgacuuuucggacuuuaagaugaacauccaagagauuaagaaacaaaucaaggauauuaaugacaauaagacguaugagcguauuacagugaaaaccagugacaagacuaucguaauuaacgacgauuuugaguacaucauuucaaucuuugcguuguugaacucuaaugccguaaucaacaagauucgcaaccguuucuucgcgacgucaguguggcugaacaccucagaguaccagaauauuaucgauauccuggacgagauuaugcagcugaauacgcugcguaacgaguguauuaccgaaaacuggaaccucaacuuagaagaguuuauccaaaagaugaaggaaaucgagaaggacuuugaugauuuuaaaauucagacaaagaaggagaucuuuaacaacuauuacgaggacaucaaaaacaacaucuuaacggaauuuaaagacgauauuaacgguugcgacgugcuugaaaagaaguuggagaaaaucguaaucuuugacgacgaaaccaaguuugagaucgacaagaaguccaauauuuugcaggacgagcagcguaaauugagcaauaucaauaagaaggaccugaaaaagaagguggaccaauauauuaaagacaaggaucaggaaaucaaaucgaagauuuugugccguauuaucuucaacucagacuuccuuaagaaauauaagaaggaaauugacaauuugaucgaagauauggagucugagaaugagaacaaguuccaagagauuuauuacccgaaagagcgcaagaacgaacucuauaucuauaagaaaaacuuguucuuaaauauuggaaacccaaacuuugacaagauuuauggccuuauuucgaacgauauuaagauggccgaugcuaaauucuuguuuaauaucgaugguaagaauauucguaaaaauaagauuagugaaauugacgccauuuugaagaaccuuaacgacaagcugaacggcuacucgaaagaguacaaggagaaguauaucaaaaaguugaaggaaaacgaugacuucuuugccaaaaauauccagaacaaaaauuacaagagcuucgaaaaggauuacaaccgcguuucugaguauaaaaagauccgcgaccuuguagaguucaacuauuuaaacaaaaucgaaucuuacuuaaucgauaucaacuggaaauuggcgauucaaauggcccgcuuugagcgcgacaugcacuauaucguaaauggguugcgcgaguugggaauuaucaaguugucaggauauaacacggggaucucacgugcauacccaaagcgcaauggaucagacggguuuuacacaaccacugcuuacuauaaguucuuugaugaggaauccuacaagaaauucgaaaagaucuguuacgguuucgguaucgacuugagcgaaaacagcgagaucaacaagccagaaaaugaauccauucgcaacuauauuucucacuuuuauaucguucgcaacccguuugcagacuacucuauugcggagcagaucgaccgugugucgaauuugcugaguuauagcacccgcuauaacaacucgacguaugcaucaguauucgaggucuuuaaaaaggacgugaaccuugacuaugaugaauuaaagaaaaaauucaagcuuauuggcaauaaugacaucuuggaacgcuugaugaagccgaagaaagucuccguacuugaauuagaaucguacaacucugauuacaucaagaaccugaucauugaguuauugacuaagauugaaaauacaaacgauacccuguaa

SEQ ID NO: 11026 - RNA, 4170 nt, Artificial Sequence
  Cas13a variant__Leptotrichia shahii__WP_018451595.1__Cas13a
auggggaaccuguucggacacaagcggugguacgaggugcgagauaagaaagacuucaagaucaagcgaaaggugaaagucaagcggaauuaugacgggaacaaguacauucugaacaucaacgaaaacaacaacaaagagaagaucgacaacaacaaguucaucagaaaguacaucaacuacaagaaaaacgauaauauucugaaggaguucacuaggaaauuucaugcaggaaauauccuguucaaacugaagggcaaagaagggaucauuagaauugagaauaacgacgacuuccuggagacagaggaaguggugcuguauaucgaggccuacggcaagagcgagaagcugaaagcacuggggaucacaaagaaaaagaucauugacgaggccaucaggcagggcauuacuaaggacgauaaaaagaucgagaucaagcgacaggagaacgaggaagagaucgaaauugacauccgggaugaguacacuaauaagacccugaacgacugcuccaucauucugcgcaucauugaaaacgaugaacuggagacaaagaagagcaucuacgagaucuucaagaacaucaauaugagccuguauaagaucaucgagaagaucaucgaaaacgagacagaaaagguguuugaaaauagauacuacgaagagcaccugagggagaagcugcugaaagacgauaagauugacgugauccugaccaacuucauggaaauccgggagaagaucaagucuaaucuggagauccugggcuucgugaaguuuuaccugaacgucggcggggacaaaaagaaaaguaaaaauaagaaaaugcugguggaaaagauucugaacaucaauguggaucugaccgucgaggacauugccgauuucgugaucaaggagcuggaauuuuggaacaucacaaagcgcauugagaaagugaagaaagucaauaacgaguuccuggagaagcggagaaaucggacauacaucaaguccuaugugcugcuggacaagcacgaaaaguuuaaaaucgagagagaaaacaagaaggauaagaucgugaaguucuuugucgagaacauuaagaacaacucuaucaaggaaaagauugagaagauccuggcugaguucaagaucgacgagcugauuaagaaacuggagaaggaacugaagaaagggaacugugauaccgagaucuucggaaucuuuaagaagcauuacaaggugaacuucgacagcaagaaauuuuccaagaaaucugaugaagagaaggagcuguauaagaucaucuacagauaccugaagggcagaauugaaaaaauccuggugaacgagcagaaggucagacugaagaaaauggagaagaucgagaucgaaaagauucugaaugaaaguauccugucagagaaaauucugaagagagugaaacaguauacacuggagcacauuauguaccuggggaagcugaggcauaacgacaucgauaugaccacagugaauacugacgauuucagccgccugcacgccaaggaagagcuggaccuggaacugaucaccuucuuugccagcacaaauauggagcugaacaagaucuuuucccgagaaaacaucaacaacgacgagaacaucgauuucuuuggaggcgaccgggagaagaacuaugugcuggauaagaaaauccugaauaguaagaucaagaucauccgcgaccuggauuucaucgauaacaagaacaacaucacaaacaacuucauucgaaaguuuacaaagaucggcacuaaugaaaggaaccgcauccugcaugccauuuccaaagagagggaccugcaggggacucaggacgauuacaacaaagugaucaacaucauucagaaucugaagaucuccgaugaagaggugagcaaagcucugaaccuggacguggucuuuaaggacaagaaaaacaucaucacaaagaucaaugacaucaagaucucugaagagaacaacaacgauaucaaguaucugcccagcuucagcaaagugcugcccgaaauccugaaccuguaccgcaacaaucccaagaaugagccuuuugacacaaucgagacugaaaaaauugugcugaacgcucugaucuacgucaauaaggagcuguauaagaaacugauccuggaggacgaucuggaagagaacgaguccaagaauaucuuccugcaggaacugaagaaaacccugggcaacauugacgaaaucgaugagaacaucaucgagaacuacuacaagaacgcacagauuucugccaguaaggggaacaacaaggcaaucaagaaauaucagaagaaagugaucgagugcuacauuggauaucugcgcaaaaacuacgaagagcuguucgacuuuucagacuucaagaugaacauccaggaaaucaagaaacagauuaaggacaucaacgauaacaagacuuaugagcggaucaccgugaaaaccagcgacaaaaccauugucaucaacgacgauuucgaguacaucauuucuaucuuugcacugcugaacaguaaugccgugauuaauaagauccgaaacagauucuucgccaccagcguguggcugaacaccucagaauaccagaauaucauugacauccuggaugagauuaugcagcugaauacccugcggaacgaaugcaucacagagaacuggaaucugaaccuggaagaguucauucagaagaugaaagagaucgaaaaggauuucgacgacuucaagauccagacuaagaaagaaaucuucaacaacuacuacgaggacaucaagaacaacauucugaccgaguuuaaagacgauaucaacggcugugaugugcuggaaaagaaacuggagaagauugucaucuucgacgaugaaaccaaguucgagaucgacaagaaauccaacauccugcaggaugaacagagaaagcugucuaacaucaacaagaaggaccugaagaaaaagguggaucaguauaucaaggacaaagaucaggagaucaagucuaaaauccugugcaggaucauuuucaacagugacuuucugaaaaaguacaagaaggaaaucgacaaucugauugaggauauggagucugaaaaugagaacaaguuccaggagaucuacuaucccaaggaacggaagaacgagcuguauaucuacaaaaagaaucuguuccugaacaucggaaauccuaacuuugacaagaucuacggccugauuagcaacgacaucaagauggccgaugcuaaauuccuguuuaauaucgauggaaagaacaucagaaagaacaaaaucagugagaucgacgcuauucugaagaaucugaacgauaaacugaacggcuacucaaaggaauacaaggagaaguacaucaaaaagcugaaggagaacgacgauuucuuugcaaagaacauccagaauaagaacuacaaauccuucgaaaaggacuauaaccgcgugucugaguacaaaaagauucgagaucuggucgaguucaacuaucugaacaaaaucgaguccuaccugauugacaucaacuggaagcuggcuauucagauggcaagauucgaaagggauaugcacuauaucgugaauggacugagggagcugggcaucauuaagcugucaggcuauaacaccgggaucagcagggcauacccaaagcgcaauggaagcgacggcuuuuacacuaccacagccuacuacaaguucuuugaugaagaguccuacaagaaguucgagaagauuugcuacggguuuggaaucgaccugagcgaaaauuccgagaucaacaagccugaaaaugagagcauucggaacuauaucucccauuucuacaucgugagaaauccauuugccgacuacaguauugcugagcagaucgaucgggugagcaaccugcugucauauagcacacgcuacaacaauucaacuuaugccagcguguucgaagucuuuaaaaaggacgugaaucuggacuacgaugagcugaaaaagaaauucaaacugaucggcaacaaugauauucuggagcgccugaugaagcccaagaaagugagcguccuggaacuggaguccuacaacagugacuacauuaagaaucugaucauugaacugcugaccaaaaucgagaauacuaacgauacccuguga

SEQ ID NO: 11027 - RNA, 4305 nt, Artificial Sequence
  Cas13a variant__Leptotrichia shahii__WP_018451595.1__Cas13a(long)
auggggaaccuguucggacacaagcggugguacgaggugcgagauaagaaagacuucaagaucaagcgaaaggugaaagucaagcggaauuaugacgggaacaaguacauucugaacaucaacgaaaacaacaacaaagagaagaucgacaacaacaaguucaucagaaaguacaucaacuacaagaaaaacgauaauauucugaaggaguucacuaggaaauuucaugcaggaaauauccuguucaaacugaagggcaaagaagggaucauuagaauugagaauaacgacgacuuccuggagacagaggaaguggugcuguauaucgaggccuacggcaagagcgagaagcugaaagcacuggggaucacaaagaaaaagaucauugacgaggccaucaggcagggcauuacuaaggacgauaaaaagaucgagaucaagcgacaggagaacgaggaagagaucgaaauugacauccgggaugaguacacuaauaagacccugaacgacugcuccaucauucugcgcaucauugaaaacgaugaacuggagacaaagaagagcaucuacgagaucuucaagaacaucaauaugagccuguauaagaucaucgagaagaucaucgaaaacgagacagaaaagguguuugaaaauagauacuacgaagagcaccugagggagaagcugcugaaagacgauaagauugacgugauccugaccaacuucauggaaauccgggagaagaucaagucuaaucuggagauccugggcuucgugaaguuuuaccugaacgucggcggggacaaaaagaaaaguaaaaauaagaaaaugcugguggaaaagauucugaacaucaauguggaucugaccgucgaggacauugccgauuucgugaucaaggagcuggaauuuuggaacaucacaaagcgcauugagaaagugaagaaagucaauaacgaguuccuggagaagcggagaaaucggacauacaucaaguccuaugugcugcuggacaagcacgaaaaguuuaaaaucgagagagaaaacaagaaggauaagaucgugaaguucuuugucgagaacauuaagaacaacucuaucaaggaaaagauugagaagauccuggcugaguucaagaucgacgagcugauuaagaaacuggagaaggaacugaagaaagggaacugugauaccgagaucuucggaaucuuuaagaagcauuacaaggugaacuucgacagcaagaaauuuuccaagaaaucugaugaagagaaggagcuguauaagaucaucuacagauaccugaagggcagaauugaaaaaauccuggugaacgagcagaaggucagacugaagaaaauggagaagaucgagaucgaaaagauucugaaugaaaguauccugucagagaaaauucugaagagagugaaacaguauacacuggagcacauuauguaccuggggaagcugaggcauaacgacaucgauaugaccacagugaauacugacgauuucagccgccugcacgccaaggaagagcuggaccuggaacugaucaccuucuuugccagcacaaauauggagcugaacaagaucuuuucccgagaaaacaucaacaacgacgagaacaucgauuucuuuggaggcgaccgggagaagaacuaugugcuggauaagaaaauccugaauaguaagaucaagaucauccgcgaccuggauuucaucgauaacaagaacaacaucacaaacaacuucauucgaaaguuuacaaagaucggcacuaaugaaaggaaccgcauccugcaugccauuuccaaagagagggaccugcaggggacucaggacgauuacaacaaagugaucaacaucauucagaaucugaagaucuccgaugaagaggugagcaaagcucugaaccuggacguggucuuuaaggacaagaaaaacaucaucacaaagaucaaugacaucaagaucucugaagagaacaacaacgauaucaaguaucugcccagcuucagcaaagugcugcccgaaauccugaaccuguaccgcaacaaucccaagaaugagccuuuugacacaaucgagacugaaaaaauugugcugaacgcucugaucuacgucaauaaggagcuguauaagaaacugauccuggaggacgaucuggaagagaacgaguccaagaauaucuuccugcaggaacugaagaaaacccugggcaacauugacgaaaucgaugagaacaucaucgagaacuacuacaagaacgcacagauuucugccaguaaggggaacaacaaggcaaucaagaaauaucagaagaaagugaucgagugcuacauuggauaucugcgcaaaaacuacgaagagcuguucgacuuuucagacuucaagaugaacauccaggaaaucaagaaacagauuaaggacaucaacgauaacaagacuuaugagcggaucaccgugaaaaccagcgacaaaaccauugucaucaacgacgauuucgaguacaucauuucuaucuuugcacugcugaacaguaaugccgugauuaauaagauccgaaacagauucuucgccaccagcguguggcugaacaccucagaauaccagaauaucauugacauccuggaugagauuaugcagcugaauacccugcggaacgaaugcaucacagagaacuggaaucugaaccuggaagaguucauucagaagaugaaagagaucgaaaaggauuucgacgacuucaagauccagacuaagaaagaaaucuucaacaacuacuacgaggacaucaagaacaacauucugaccgaguuuaaagacgauaucaacggcugugaugugcuggaaaagaaacuggagaagauugucaucuucgacgaugaaaccaaguucgagaucgacaagaaauccaacauccugcaggaugaacagagaaagcugucuaacaucaacaagaaggaccugaagaaaaagguggaucaguauaucaaggacaaagaucaggagaucaagucuaaaauccugugcaggaucauuuucaacagugacuuucugaaaaaguacaagaaggaaaucgacaaucugauugaggauauggagucugaaaaugagaacaaguuccaggagaucuacuaucccaaggaacggaagaacgagcuguauaucuacaaaaagaaucuguuccugaacaucggaaauccuaacuuugacaagaucuacggccugauuagcaacgacaucaagauggccgaugcuaaauuccuguuuaauaucgauggaaagaacaucagaaagaacaaaaucagugagaucgacgcuauucugaagaaucugaacgauaaacugaacggcuacucaaaggaauacaaggagaaguacaucaaaaagcugaaggagaacgacgauuucuuugcaaagaacauccagaauaagaacuacaaauccuucgaaaaggacuauaaccgcgugucugaguacaaaaagauucgagaucuggucgaguucaacuaucugaacaaaaucgaguccuaccugauugacaucaacuggaagcuggcuauucagauggcaagauucgaaagggauaugcacuauaucgugaauggacugagggagcugggcaucauuaagcugucaggcuauaacaccgggaucagcagggcauacccaaagcgcaauggaagcgacggcuuuuacacuaccacagccuacuacaaguucuuugaugaagaguccuacaagaaguucgagaagauuugcuacggguuuggaaucgaccugagcgaaaauuccgagaucaacaagccugaaaaugagagcauucggaacuauaucucccauuucuacaucgugagaaauccauuugccgacuacaguauugcugagcagaucgaucgggugagcaaccugcugucauauagcacacgcuacaacaauucaacuuaugccagcguguucgaagucuuuaaaaaggacgugaaucuggacuacgaugagcugaaaaagaaauucaaacugaucggcaacaaugauauucuggagcgccugaugaagcccaagaaagugagcguccuggaacuggaguccuacaacagugacuacauuaagaaucugaucauugaacugcugaccaaaaucgagaauacuaacgauacccugaaaaggccggcggccacgaaaaaggccggccaggcaaaaaagaaaaagggauccuacccauacgauguuccagauuacgcuuaucccuacgacgugccugauuaugcauacccauaugauguccccgacuaugccuaa

SEQ ID NO: 11028 - RNA, 4158 nt, Artificial Sequence
  Cas13a variant__Leptotrichia sp. oral__WP_021744063.1__Cas13a
augggaaauuuauuuggacauaagagaugguaugaaguucgugauaaaaaagauuuuaaaauaaaacggaaaguaaaaguuaaaaggaacuaugauggaaacaaauacauuuuaaauauuaaugaaaauaauaauaaagaaaaaauugauaauaauaaauuuauuggagaauuuguuaauuauaaaaaaaauaauaauguucuuaaagaauuuaaaaggaaauuucaugcaggaaauauucuauuuaaguugaaagguaaagaagaaaucauaagaauagaaaauaaugaugauuuuuuggaaacagaagaaguuguauuauauauagaaguauauggaaaaucugagaaauugaaagcacuggagauuacaaaaaagaaaauaauagaugaagcaauuaggcaaggaauaacuaaagaugauaaaaaaauagaaauaaagagacaagagaaugaagaagaaauagagauagauaucagagaugaguauacuaauaaaacacuaaaugauuguucaauaauauuaagaauaauagaaaaugaugaauuagaaacaaaaaaaucaauuuacgaaauuuuuaaaaauauuaacaugaguuuauauaagauuauagaaaaaauaauugaaaaugaaacagaaaaaguauuugaaaaucgauauuaugaagaacauuuaagagaaaaauuauugaaagauaauaaaauagauguuauuuugacuaauuuuauggaaauaagagaaaaaauaaaaaguaauuuagaaauuauggguuuuguaaaauuuuaucuuaauguuaguggugauaaaaagaaaucugaaaauaaaaaaauguuuguugaaaagauuuuaaauacaaauguagauuuaacgguagaagauauaguagauuuuauuguaaaagaauuaaaauuuuggaauauuacuaaaagaauugaaaaaguaaaaaaauuuaauaaugaauuucuugaaaauagaagaaauagaacauauauaaaaucuuauguacuauuagauaagcacgaaaaauuuaaaauagaaagagaaaauaaaaaagauaaaauuguaaaauuuuuuguagaaaauauaaaaaauaauaguauaaaagaaaaaauagaaaaaauuuuagcagaauuuaaaauaaaugaauuaauaaaaaaacuagaaaaagaacuaaaaaaaggaaauugugauacagaaauuuuuggaauauuuaaaaaacauuauaaaguuaauuuugauucgaaaaaauuuucaaauaaaucugaugaagaaaaagaacuauauaaaaucauauaucgauauuuaaaaggaagaauugaaaaaauauugguaaaugaacaaaaagucagauuaaagaaaauggaaaaaauagaaauagaaaaaauuuuaaaugaaaguauauuaucugaaaaaauuuuaaaaagaguuaagcaauauacguuagagcauauuauguauuuagggaaauuaagacauaaugauauaguuaaaaugacaguaaauacugaugauuuuucuagacuucacgcuaaagaagaguuggauuuagaauugauuacuuuuuuugcuucuacuaauauggaauugaauaagauuuuuaauggaaaagaaaaaguaacagauuuuuuuggcuuuaauuuaaauggccaaaaaauuacacuaaaagaaaaaguuccuaguuucaaauuaaauauuuuaaaaaaguuaaauuuuauaaauaaugaaaauaauauugaugaaaaauuaucucauuucuauucuuuucagaaagaaggauacuuauuaagaaauaaaauuuuacauaauucuuauggaaauauucaagaaacuaaaaauuuaaaaggagaauaugaaaauguugaaaaguuaauaaaagaacuaaaaguuagugaugaagaaauuucuaaguccuuaaguuuagauguuauauuugaagguaaaguugauauaauuaacaaaauuaauaguuuaaaaauaggagaauacaaagauaaaaaauauuuaccuucuuuuucaaaaauuguucuugaaauaacgagaaaauuuagagaaauaaauaaagauaaauuguuugauauugaaagugaaaaaauaauauuaaaugcagugaaauauguuaauaaaauauuauaugaaaaaauaacuucaaaugaagagaacgaauuuuuaaaaacauuaccugacaaauuaguaaaaaaaaguaauaauaaaaaagaaaacaaaaaucuauuaucaauagaagaauauuauaaaaaugcucaaguaucaucaucaaaaggagacaaaaaagcuauaaaaaaauaucaaaacaaaguuacaaacgcuuaucuugaauauuuagagaauacauuuacagaaauaauagauuuuucaaaauucaauuugaauuaugaugaaauaaaaacuaaaauugaagaaagaaaagauaauaaaaguaaaauuauuauagauucuauuucuacaaauauaaauauaaccaaugauauugaguauauaauuucaauauuugcauuauuaaauaguaacacguauauaaauaaaauuagaaauagauuuuuugcaacaucaguuugguuagaaaaacaaaacgguaccaaagaauaugauuaugaaaauauuauaaguauuuuagaugaaguuuuauuaauaaauuuauuaagagaaaauaauauaacugauauuuuagauuuaaaaaaugcgauuauagaugccaaaauaguggagaaugaugaaacauauauuaagaauuauauuuuugaaaguaaugaagaaaaauugaaaaaaagauuguuuugugaagaacuugucgauaaagaagacauucgaaaaauauuugaagaugaaaauuuuaaauuuaaaaguuucauaaagaaaaaugaaauuggaaauuuuaagauuaauuuugguauuuuaucuaacuuagaguguaauucugaaguagaggcaaaaaaaauaauagggaaaaauucaaaaaaauuagaguccuuuauacagaauauuauugaugaauauaaaucaaacauaagaacuuuauuuucaucagaauuucuagaaaaauauaaggaagaaauagauaauuuaguagaagauacagaaucagagaauaaaaauaaauuugaaaaaauauauuauccuaaagaacauaagaaugaacuauauauuuauaaaaagaauuuauuuuuaaauauugggaauccaaauuuugauaagauuuauggauuaauuucaaaagauauaaaaaauguugacacaaaaauauuauuugacgacgauauuaaaaaaaauaaaauaucugaaauugaugcaauauugaaaaauuuaaaugauaaauugaauggauauucuaacgauuauaaagcaaaauauguaaacaaauugaaagaaaaugaugauuuuuuugccaaaaauauacaaaaugaaaauuauaguucauuuggagaauuugaaaaggauuauaauaaaguuucugaguauaaaaaaauaagagauuugguagaauuuaauuauuugaauaaaauagaaaguuauuugauagauauaaauuggaaacuugcuauucaaauggcuagauuugaaagagauaugcacuauauuguaaaugggcuaagagaauuaggaauuauuaaguuaaguggcuacaauacuggaauaaguagagcuuauccuaagcguaauggaucugauggcuuuuauacaacaacagcauacuauaaauuuuuugaugaagaaucuuauaaaaaauuugagaaaauauguuauggauuuggaauugauuugucugaaaauucugaaauuaauaagccggaaaaugaaaguauuagaaacuauauuucacauuucuauauuguaagaaauccauuugcugauuacaguauugcagaacaaauugauagaguuucuaauuuauuaucauauaguacacguuauaauaauucaacuuaugcaaguguauuugaaguauuuaaaaaagaugugaauuuagauuaugaugaauuaaagaaaaaauuuagacuuaucgguaauaaugauauacuugaaagauuaaugaaaccuaaaaaaguuucuguuuuagaauuagaaaguuauaauucugauuauauuaaaaacuugauaauagaacuuuuaacaaaaauagaaaauacaaaugauacguuauaa

SEQ ID NO: 11029 - RNA, 3459 nt, Artificial Sequence
  Cas13a variant__Leptotrichia wadei__WP_021746774.1__Cas13a
augaaagugaccaaggucgacggcaucagccacaagaaguacaucgaagagggcaagcucgugaaguccaccagcgaggaaaaccggaccagcgagagacugagcgagcugcugagcauccggcuggacaucuacaucaagaaccccgacaacgccuccgaggaagagaaccggaucagaagagagaaccugaagaaguucuuuagcaacaaggugcugcaccugaaggacagcgugcuguaucugaagaaccggaaagaaaagaacgccgugcaggacaagaacuauagcgaagaggacaucagcgaguacgaccugaaaaacaagaacagcuucuccgugcugaagaagauccugcugaacgaggacgugaacucugaggaacuggaaaucuuucggaaggacguggaagccaagcugaacaagaucaacagccugaaguacagcuucgaagagaacaaggccaacuaccagaagaucaacgagaacaacguggaaaaagugggcggcaagagcaagcggaacaucaucuacgacuacuacagagagagcgccaagcgcaacgacuacaucaacaacgugcaggaagccuucgacaagcuguauaagaaagaggauaucgagaaacuguuuuuccugaucgagaacagcaagaagcacgagaaguacaagauccgcgaguacuaucacaagaucaucggccggaagaacgacaaagagaacuucgccaagauuaucuacgaagagauccagaacgugaacaacaucaaagagcugauugagaagauccccgacaugucugagcugaagaaaagccagguguucuacaaguacuaccuggacaaagaggaacugaacgacaagaauauuaaguacgccuucugccacuucguggaaaucgagaugucccagcugcugaaaaacuacguguacaagcggcugagcaacaucagcaacgauaagaucaagcggaucuucgaguaccagaaucugaaaaagcugaucgaaaacaaacugcugaacaagcuggacaccuacgugcggaacugcggcaaguacaacuacuaucugcaagugggcgagaucgccaccuccgacuuuaucgcccggaaccggcagaacgaggccuuccugagaaacaucaucggcguguccagcguggccuacuucagccugaggaacauccuggaaaccgagaacgagaacgguaucaccggccggaugcggggcaagaccgugaagaacaacaagggcgaagagaaauacguguccggcgagguggacaagaucuacaaugagaacaagcagaacgaagugaaagaaaaucugaagauguucuacagcuacgacuucaacauggacaacaagaacgagaucgaggacuucuucgccaacaucgacgaggccaucagcagcaucagacacggcaucgugcacuucaaccuggaacuggaaggcaaggacaucuucgccuucaagaauaucgcccccagcgagaucuccaagaagauguuucagaacgaaaucaacgaaaagaagcugaagcugaaaaucuucaagcagcugaacagcgccaacguguucaacuacuacgagaaggaugugaucaucaaguaccugaagaauaccaaguucaacuucgugaacaaaaacauccccuucgugcccagcuucaccaagcuguacaacaagauugaggaccugcggaauacccugaaguuuuuuuggagcgugcccaaggacaaagaagagaaggacgcccagaucuaccugcugaagaauaucuacuacggcgaguuccugaacaaguucgugaaaaacuccaagguguucuuuaagaucaccaaugaagugaucaagauuaacaagcagcggaaccagaaaaccggccacuacaaguaucagaaguucgagaacaucgagaaaaccgugcccguggaauaccuggccaucauccagagcagagagaugaucaacaaccaggacaaagaggaaaagaauaccuacaucgacuuuauucagcagauuuuccugaagggcuucaucgacuaccugaacaagaacaaucugaaguauaucgagagcaacaacaacaaugacaacaacgacaucuucuccaagaucaagaucaaaaaggauaacaaagagaaguacgacaagauccugaagaacuaugagaagcacaaucggaacaaagaaaucccucacgagaucaaugaguucgugcgcgagaucaagcuggggaagauucugaaguacaccgagaaucugaacauguuuuaccugauccugaagcugcugaaccacaaagagcugaccaaccugaagggcagccuggaaaaguaccaguccgccaacaaagaagaaaccuucagcgacgaguuggaacugaucaaccugcugaaccuggacaacaacagagugaccgaggacuucgagcuggaagccaacgagaucggcaaguuccuggacuucaacgaaaacaaaaucaaggaccggaaagagcugaaaaaguucgacaccaacaagaucuauuucgacggcgagaacaucaucaagcaccgggccuucuacaauaucaagaaauacggcaugcugaaucugcuggaaaagaucgccgauaaggccaaguauaagaucagccugaaagaacugaaagaguacagcaacaagaagaaugagauugaaaagaacuacaccaugcagcagaaccugcaccggaaguacgccagacccaagaaggacgaaaaguucaacgacgaggacuacaaagaguaugagaaggccaucggcaacauccagaaguacacccaccugaagaacaagguggaauucaaugagcugaaccugcugcagggccugcugcugaagauccugcaccggcucgugggcuacaccagcaucugggagcgggaccugagauuccggcugaagggcgaguuucccgagaaccacuacaucgaggaaauuuucaauuucgacaacuccaagaaugugaaguacaaaagcggccagaucguggaaaaguauaucaacuucuacaaagaacuguacaaggacaauguggaaaagcggagcaucuacuccgacaagaaagugaagaaacugaagcaggaaaaaaaggaccuguacauccggaacuacauugcccacuucaacuacaucccccacgccgagauuagccugcuggaagugcuggaaaaccugcggaagcugcuguccuacgaccggaagcugaagaacgccaucaugaaguccaucguggacauucugaaagaauacggcuucguggccaccuucaagaucggcgcugacaagaagaucgaaauccagacccuggaaucagagaagaucgugcaccugaagaaucugaagaaaaagaaacugaugaccgaccggaacagcgaggaacugugcgaacucgugaaagucauguucgaguacaaggcccuggaauga

SEQ ID NO: 11030 - RNA, 3459 nt, Artificial Sequence
  Cas13a variant__Leptotrichia wadei__WP_021746774.1__Cas13a(G403D)
augaaagugaccaaggucgacggcaucagccacaagaaguacaucgaagagggcaagcucgugaaguccaccagcgaggaaaaccggaccagcgagagacugagcgagcugcugagcauccggcuggacaucuacaucaagaaccccgacaacgccuccgaggaagagaaccggaucagaagagagaaccugaagaaguucuuuagcaacaaggugcugcaccugaaggacagcgugcuguaucugaagaaccggaaagaaaagaacgccgugcaggacaagaacuauagcgaagaggacaucagcgaguacgaccugaaaaacaagaacagcuucuccgugcugaagaagauccugcugaacgaggacgugaacucugaggaacuggaaaucuuucggaaggacguggaagccaagcugaacaagaucaacagccugaaguacagcuucgaagagaacaaggccaacuaccagaagaucaacgagaacaacguggaaaaagugggcggcaagagcaagcggaacaucaucuacgacuacuacagagagagcgccaagcgcaacgacuacaucaacaacgugcaggaagccuucgacaagcuguauaagaaagaggauaucgagaaacuguuuuuccugaucgagaacagcaagaagcacgagaaguacaagauccgcgaguacuaucacaagaucaucggccggaagaacgacaaagagaacuucgccaagauuaucuacgaagagauccagaacgugaacaacaucaaagagcugauugagaagauccccgacaugucugagcugaagaaaagccagguguucuacaaguacuaccuggacaaagaggaacugaacgacaagaauauuaaguacgccuucugccacuucguggaaaucgagaugucccagcugcugaaaaacuacguguacaagcggcugagcaacaucagcaacgauaagaucaagcggaucuucgaguaccagaaucugaaaaagcugaucgaaaacaaacugcugaacaagcuggacaccuacgugcggaacugcggcaaguacaacuacuaucugcaagugggcgagaucgccaccuccgacuuuaucgcccggaaccggcagaacgaggccuuccugagaaacaucaucggcguguccagcguggccuacuucagccugaggaacauccuggaaaccgagaacgagaacgauaucaccggccggaugcggggcaagaccgugaagaacaacaagggcgaagagaaauacguguccggcgagguggacaagaucuacaaugagaacaagcagaacgaagugaaagaaaaucugaagauguucuacagcuacgacuucaacauggacaacaagaacgagaucgaggacuucuucgccaacaucgacgaggccaucagcagcaucagacacggcaucgugcacuucaaccuggaacuggaaggcaaggacaucuucgccuucaagaauaucgcccccagcgagaucuccaagaagauguuucagaacgaaaucaacgaaaagaagcugaagcugaaaaucuucaagcagcugaacagcgccaacguguucaacuacuacgagaaggaugugaucaucaaguaccugaagaauaccaaguucaacuucgugaacaaaaacauccccuucgugcccagcuucaccaagcuguacaacaagauugaggaccugcggaauacccugaaguuuuuuuggagcgugcccaaggacaaagaagagaaggacgcccagaucuaccugcugaagaauaucuacuacggcgaguuccugaacaaguucgugaaaaacuccaagguguucuuuaagaucaccaaugaagugaucaagauuaacaagcagcggaaccagaaaaccggccacuacaaguaucagaaguucgagaacaucgagaaaaccgugcccguggaauaccuggccaucauccagagcagagagaugaucaacaaccaggacaaagaggaaaagaauaccuacaucgacuuuauucagcagauuuuccugaagggcuucaucgacuaccugaacaagaacaaucugaaguauaucgagagcaacaacaacaaugacaacaacgacaucuucuccaagaucaagaucaaaaaggauaacaaagagaaguacgacaagauccugaagaacuaugagaagcacaaucggaacaaagaaaucccucacgagaucaaugaguucgugcgcgagaucaagcuggggaagauucugaaguacaccgagaaucugaacauguuuuaccugauccugaagcugcugaaccacaaagagcugaccaaccugaagggcagccuggaaaaguaccaguccgccaacaaagaagaaaccuucagcgacgagcuggaacugaucaaccugcugaaccuggacaacaacagagugaccgaggacuucgagcuggaagccaacgagaucggcaaguuccuggacuucaacgaaaacaaaaucaaggaccggaaagagcugaaaaaguucgacaccaacaagaucuauuucgacggcgagaacaucaucaagcaccgggccuucuacaauaucaagaaauacggcaugcugaaucugcuggaaaagaucgccgauaaggccaaguauaagaucagccugaaagaacugaaagaguacagcaacaagaagaaugagauugaaaagaacuacaccaugcagcagaaccugcaccggaaguacgccagacccaagaaggacgaaaaguucaacgacgaggacuacaaagaguaugagaaggccaucggcaacauccagaaguacacccaccugaagaacaagguggaauucaaugagcugaaccugcugcagggccugcugcugaagauccugcaccggcucgugggcuacaccagcaucugggagcgggaccugagauuccggcugaagggcgaguuucccgagaaccacuacaucgaggaaauuuucaauuucgacaacuccaagaaugugaaguacaaaagcggccagaucguggaaaaguauaucaacuucuacaaagaacuguacaaggacaauguggaaaagcggagcaucuacuccgacaagaaagugaagaaacugaagcaggaaaaaaaggaccuguacauccggaacuacauugcccacuucaacuacaucccccacgccgagauuagccugcuggaagugcuggaaaaccugcggaagcugcuguccuacgaccggaagcugaagaacgccaucaugaaguccaucguggacauucugaaagaauacggcuucguggccaccuucaagaucggcgcugacaagaagaucgaaauccagacccuggaaucagagaagaucgugcaccugaagaaucugaagaaaaagaaacugaugaccgaccggaacagcgaggaacugugcgaacucgugaaagucauguucgaguacaaggcccuggaauaa

SEQ ID NO: 11031 - RNA, 3909 nt, Artificial Sequence
  Cas13a variant__Leptotrichia wadei__WP_021746774.1__6xHis-Tag/Twin-Strep/SUMO_Cas13a(G403D)
augggcagcagccaucaucaucaucaucacagcagcggccuggugccgcgcggcagccauauggcuagcuggagccauccgcaguuugaaaaagguggugguagcgguggugguucaggugguagugcauggucacacccucaguuugagaaaaugucggacucagaagucaaucaagaagcuaagccagaggucaagccagaagucaagccugagacucacaucaauuuaaagguguccgauggaucuucagagaucuucuucaagaucaaaaagaccacuccuuuaagaaggcugauggaagcguucgcuaaaagacaggguaaggaaauggacuccuuaagauucuuguacgacgguauuagaauccaagcugaucagaccccugaagauuuggacauggaggauaacgauauuauugaggcucacagagaacagauugguggauccaugaaagugaccaaggucgacggcaucagccacaagaaguacaucgaagagggcaagcucgugaaguccaccagcgaggaaaaccggaccagcgagagacugagcgagcugcugagcauccggcuggacaucuacaucaagaaccccgacaacgccuccgaggaagagaaccggaucagaagagagaaccugaagaaguucuuuagcaacaaggugcugcaccugaaggacagcgugcuguaucugaagaaccggaaagaaaagaacgccgugcaggacaagaacuauagcgaagaggacaucagcgaguacgaccugaaaaacaagaacagcuucuccgugcugaagaagauccugcugaacgaggacgugaacucugaggaacuggaaaucuuucggaaggacguggaagccaagcugaacaagaucaacagccugaaguacagcuucgaagagaacaaggccaacuaccagaagaucaacgagaacaacguggaaaaagugggcggcaagagcaagcggaacaucaucuacgacuacuacagagagagcgccaagcgcaacgacuacaucaacaacgugcaggaagccuucgacaagcuguauaagaaagaggauaucgagaaacuguuuuuccugaucgagaacagcaagaagcacgagaaguacaagauccgcgaguacuaucacaagaucaucggccggaagaacgacaaagagaacuucgccaagauuaucuacgaagagauccagaacgugaacaacaucaaagagcugauugagaagauccccgacaugucugagcugaagaaaagccagguguucuacaaguacuaccuggacaaagaggaacugaacgacaagaauauuaaguacgccuucugccacuucguggaaaucgagaugucccagcugcugaaaaacuacguguacaagcggcugagcaacaucagcaacgauaagaucaagcggaucuucgaguaccagaaucugaaaaagcugaucgaaaacaaacugcugaacaagcuggacaccuacgugcggaacugcggcaaguacaacuacuaucugcaagugggcgagaucgccaccuccgacuuuaucgcccggaaccggcagaacgaggccuuccugagaaacaucaucggcguguccagcguggccuacuucagccugaggaacauccuggaaaccgagaacgagaacgauaucaccggccggaugcggggcaagaccgugaagaacaacaagggcgaagagaaauacguguccggcgagguggacaagaucuacaaugagaacaagcagaacgaagugaaagaaaaucugaagauguucuacagcuacgacuucaacauggacaacaagaacgagaucgaggacuucuucgccaacaucgacgaggccaucagcagcaucagacacggcaucgugcacuucaaccuggaacuggaaggcaaggacaucuucgccuucaagaauaucgcccccagcgagaucuccaagaagauguuucagaacgaaaucaacgaaaagaagcugaagcugaaaaucuucaagcagcugaacagcgccaacguguucaacuacuacgagaaggaugugaucaucaaguaccugaagaauaccaaguucaacuucgugaacaaaaacauccccuucgugcccagcuucaccaagcuguacaacaagauugaggaccugcggaauacccugaaguuuuuuuggagcgugcccaaggacaaagaagagaaggacgcccagaucuaccugcugaagaauaucuacuacggcgaguuccugaacaaguucgugaaaaacuccaagguguucuuuaagaucaccaaugaagugaucaagauuaacaagcagcggaaccagaaaaccggccacuacaaguaucagaaguucgagaacaucgagaaaaccgugcccguggaauaccuggccaucauccagagcagagagaugaucaacaaccaggacaaagaggaaaagaauaccuacaucgacuuuauucagcagauuuuccugaagggcuucaucgacuaccugaacaagaacaaucugaaguauaucgagagcaacaacaacaaugacaacaacgacaucuucuccaagaucaagaucaaaaaggauaacaaagagaaguacgacaagauccugaagaacuaugagaagcacaaucggaacaaagaaaucccucacgagaucaaugaguucgugcgcgagaucaagcuggggaagauucugaaguacaccgagaaucugaacauguuuuaccugauccugaagcugcugaaccacaaagagcugaccaaccugaagggcagccuggaaaaguaccaguccgccaacaaagaagaaaccuucagcgacgagcuggaacugaucaaccugcugaaccuggacaacaacagagugaccgaggacuucgagcuggaagccaacgagaucggcaaguuccuggacuucaacgaaaacaaaaucaaggaccggaaagagcugaaaaaguucgacaccaacaagaucuauuucgacggcgagaacaucaucaagcaccgggccuucuacaauaucaagaaauacggcaugcugaaucugcuggaaaagaucgccgauaaggccaaguauaagaucagccugaaagaacugaaagaguacagcaacaagaagaaugagauugaaaagaacuacaccaugcagcagaaccugcaccggaaguacgccagacccaagaaggacgaaaaguucaacgacgaggacuacaaagaguaugagaaggccaucggcaacauccagaaguacacccaccugaagaacaagguggaauucaaugagcugaaccugcugcagggccugcugcugaagauccugcaccggcucgugggcuacaccagcaucugggagcgggaccugagauuccggcugaagggcgaguuucccgagaaccacuacaucgaggaaauuuucaauuucgacaacuccaagaaugugaaguacaaaagcggccagaucguggaaaaguauaucaacuucuacaaagaacuguacaaggacaauguggaaaagcggagcaucuacuccgacaagaaagugaagaaacugaagcaggaaaaaaaggaccuguacauccggaacuacauugcccacuucaacuacaucccccacgccgagauuagccugcuggaagugcuggaaaaccugcggaagcugcuguccuacgaccggaagcugaagaacgccaucaugaaguccaucguggacauucugaaagaauacggcuucguggccaccuucaagaucggcgcugacaagaagaucgaaauccagacccuggaaucagagaagaucgugcaccugaagaaucugaagaaaaagaaacugaugaccgaccggaacagcgaggaacugugcgaacucgugaaagucauguucgaguacaaggcccuggaauaa

SEQ ID NO: 11032 - RNA, 3459 nt, Artificial Sequence
  Cas13a variant__Leptotrichia wadei__WP_021746774.1__Cas13a(R474A,R1046A)
augaaagugaccaaggucgacggcaucagccacaagaaguacaucgaagagggcaagcucgugaaguccaccagcgaggaaaaccggaccagcgagagacugagcgagcugcugagcauccggcuggacaucuacaucaagaaccccgacaacgccuccgaggaagagaaccggaucagaagagagaaccugaagaaguucuuuagcaacaaggugcugcaccugaaggacagcgugcuguaucugaagaaccggaaagaaaagaacgccgugcaggacaagaacuauagcgaagaggacaucagcgaguacgaccugaaaaacaagaacagcuucuccgugcugaagaagauccugcugaacgaggacgugaacucugaggaacuggaaaucuuucggaaggacguggaagccaagcugaacaagaucaacagccugaaguacagcuucgaagagaacaaggccaacuaccagaagaucaacgagaacaacguggaaaaagugggcggcaagagcaagcggaacaucaucuacgacuacuacagagagagcgccaagcgcaacgacuacaucaacaacgugcaggaagccuucgacaagcuguauaagaaagaggauaucgagaaacuguuuuuccugaucgagaacagcaagaagcacgagaaguacaagauccgcgaguacuaucacaagaucaucggccggaagaacgacaaagagaacuucgccaagauuaucuacgaagagauccagaacgugaacaacaucaaagagcugauugagaagauccccgacaugucugagcugaagaaaagccagguguucuacaaguacuaccuggacaaagaggaacugaacgacaagaauauuaaguacgccuucugccacuucguggaaaucgagaugucccagcugcugaaaaacuacguguacaagcggcugagcaacaucagcaacgauaagaucaagcggaucuucgaguaccagaaucugaaaaagcugaucgaaaacaaacugcugaacaagcuggacaccuacgugcggaacugcggcaaguacaacuacuaucugcaagugggcgagaucgccaccuccgacuuuaucgcccggaaccggcagaacgaggccuuccugagaaacaucaucggcguguccagcguggccuacuucagccugaggaacauccuggaaaccgagaacgagaacgguaucaccggccggaugcggggcaagaccgugaagaacaacaagggcgaagagaaauacguguccggcgagguggacaagaucuacaaugagaacaagcagaacgaagugaaagaaaaucugaagauguucuacagcuacgacuucaacauggacaacaagaacgagaucgaggacuucuucgccaauaucgaugaggccaucucuaguauugcucacggcaucgugcauuucaaccuggaacuggaaggcaaggacaucuucgccuucaagaauaucgcccccagcgagaucuccaagaagauguuucagaacgaaaucaacgaaaagaagcugaagcugaaaaucuucaagcagcugaacagcgccaacguguucaacuacuacgagaaggaugugaucaucaaguaccugaagaauaccaaguucaacuucgugaacaaaaacauccccuucgugcccagcuucaccaagcuguacaacaagauugaggaccugcggaauacccugaaguuuuuuuggagcgugcccaaggacaaagaagagaaggacgcccagaucuaccugcugaagaauaucuacuacggcgaguuccugaacaaguucgugaaaaacuccaagguguucuuuaagaucaccaaugaagugaucaagauuaacaagcagcggaaccagaaaaccggccacuacaaguaucagaaguucgagaacaucgagaaaaccgugcccguggaauaccuggccaucauccagagcagagagaugaucaacaaccaggacaaagaggaaaagaauaccuacaucgacuuuauucagcagauuuuccugaagggcuucaucgacuaccugaacaagaacaaucugaaguauaucgagagcaacaacaacaaugacaacaacgacaucuucuccaagaucaagaucaaaaaggauaacaaagagaaguacgacaagauccugaagaacuaugagaagcacaaucggaacaaagaaaucccucacgagaucaaugaguucgugcgcgagaucaagcuggggaagauucugaaguacaccgagaaucugaacauguuuuaccugauccugaagcugcugaaccacaaagagcugaccaaccugaagggcagccuggaaaaguaccaguccgccaacaaagaagaaaccuucagcgacgaguuggaacugaucaaccugcugaaccuggacaacaacagagugaccgaggacuucgagcuggaagccaacgagaucggcaaguuccuggacuucaacgaaaacaaaaucaaggaccggaaagagcugaaaaaguucgacaccaacaagaucuauuucgacggcgagaacaucaucaagcaccgggccuucuacaauaucaagaaauacggcaugcugaaucugcuggaaaagaucgccgauaaggccaaguauaagaucagccugaaagaacugaaagaguacagcaacaagaagaaugagauugaaaagaacuacaccaugcagcagaaccugcaccggaaguacgccagacccaagaaggacgaaaaguucaacgacgaggacuacaaagaguaugagaaggccaucggcaacauccagaaguacacccaccugaagaacaagguggaauucaaugagcugaaccugcugcagggccugcugcugaagauccugcaccggcucgugggcuacaccagcaucugggagcgggaccugagauuccggcugaagggcgaguuucccgagaaccacuacaucgaggaaauuuucaauuucgacaacuccaagaaugugaaguacaaaagcggccagaucguggaaaaguauaucaacuucuacaaagaacuguacaaggacaauguggaaaagcggagcaucuacuccgacaagaaagugaagaaacugaagcaggagaagaaagaccuguauauugcaaacuacaucgcucacuuuaauuauauuccucaugccgagauuagccugcuggaagugcuggaaaaccugcggaagcugcuguccuacgaccggaagcugaagaacgccaucaugaaguccaucguggacauucugaaagaauacggcuucguggccaccuucaagaucggcgcugacaagaagaucgaaauccagacccuggaaucagagaagaucgugcaccugaagaaucugaagaaaaagaaacugaugaccgaccggaacagcgaggaacugugcgaacucgugaaagucauguucgaguacaaggcccuggaauga

SEQ ID NO: 11033 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggcggggagggccuucgugcgucgccgcgccgccguccccuucucccucuccagccucggggcuguccgcggggggacggcugccuucgggggggacggggcagggcgggguucggcuucuggcgugugaccggcggcucuagagccucugcuaaccauguucaugccuucuucuuuuuccuacagcuccugggcaacgugcugguuauugugcugucucaucauuuuggcaaagaauucgguaccgcgggcccgggcgccaccaugaaagugaccaaggucgacggcaucagccacaagaaguacaucgaagagggcaagcucgugaaguccaccagcgaggaaaaccggaccagcgagagacugagcgagcugcugagcauccggcuggacaucuacaucaagaaccccgacaacgccuccgaggaagagaaccggaucagaagagagaaccugaagaaguucuuuagcaacaaggugcugcaccugaaggacagcgugcuguaucugaagaaccggaaagaaaagaacgccgugcaggacaagaacuauagcgaagaggacaucagcgaguacgaccugaaaaacaagaacagcuucuccgugcugaagaagauccugcugaacgaggacgugaacucugaggaacuggaaaucuuucggaaggacguggaagccaagcugaacaagaucaacagccugaaguacagcuucgaagagaacaaggccaacuaccagaagaucaacgagaacaacguggaaaaagugggcggcaagagcaagcggaacaucaucuacgacuacuacagagagagcgccaagcgcaacgacuacaucaacaacgugcaggaagccuucgacaagcuguauaagaaagaggauaucgagaaacuguuuuuccugaucgagaacagcaagaagcacgagaaguacaagauccgcgaguacuaucacaagaucaucggccggaagaacgacaaagagaacuucgccaagauuaucuacgaagagauccagaacgugaacaacaucaaagagcugauugagaagauccccgacaugucugagcugaagaaaagccagguguucuacaaguacuaccuggacaaagaggaacugaacgacaagaauauuaaguacgccuucugccacuucguggaaaucgagaugucccagcugcugaaaaacuacguguacaagcggcugagcaacaucagcaacgauaagaucaagcggaucuucgaguaccagaaucugaaaaagcugaucgaaaacaaacugcugaacaagcuggacaccuacgugcggaacugcggcaaguacaacuacuaucugcaagugggcgagaucgccaccuccgacuuuaucgcccggaaccggcagaacgaggccuuccugagaaacaucaucggcguguccagcguggccuacuucagccugaggaacauccuggaaaccgagaacgagaacgguaucaccggccggaugcggggcaagaccgugaagaacaacaagggcgaagagaaauacguguccggcgagguggacaagaucuacaaugagaacaagcagaacgaagugaaagaaaaucugaagauguucuacagcuacgacuucaacauggacaacaagaacgagaucgaggacuucuucgccaauaucgaugaggccaucucuaguauugcucacggcaucgugcauuucaaccuggaacuggaaggcaaggacaucuucgccuucaagaauaucgcccccagcgagaucuccaagaagauguuucagaacgaaaucaacgaaaagaagcugaagcugaaaaucuucaagcagcugaacagcgccaacguguucaacuacuacgagaaggaugugaucaucaaguaccugaagaauaccaaguucaacuucgugaacaaaaacauccccuucgugcccagcuucaccaagcuguacaacaagauugaggaccugcggaauacccugaaguuuuuuuggagcgugcccaaggacaaagaagagaaggacgcccagaucuaccugcugaagaauaucuacuacggcgaguuccugaacaaguucgugaaaaacuccaagguguucuuuaagaucaccaaugaagugaucaagauuaacaagcagcggaaccagaaaaccggccacuacaaguaucagaaguucgagaacaucgagaaaaccgugcccguggaauaccuggccaucauccagagcagagagaugaucaacaaccaggacaaagaggaaaagaauaccuacaucgacuuuauucagcagauuuuccugaagggcuucaucgacuaccugaacaagaacaaucugaaguauaucgagagcaacaacaacaaugacaacaacgacaucuucuccaagaucaagaucaaaaaggauaacaaagagaaguacgacaagauccugaagaacuaugagaagcacaaucggaacaaagaaaucccucacgagaucaaugaguucgugcgcgagaucaagcuggggaagauucugaaguacaccgagaaucugaacauguuuuaccugauccugaagcugcugaaccacaaagagcugaccaaccugaagggcagccuggaaaaguaccaguccgccaacaaagaagaaaccuucagcgacgaguuggaacugaucaaccugcugaaccuggacaacaacagagugaccgaggacuucgagcuggaagccaacgagaucggcaaguuccuggacuucaacgaaaacaaaaucaaggaccggaaagagcugaaaaaguucgacaccaacaagaucuauuucgacggcgagaacaucaucaagcaccgggccuucuacaauaucaagaaauacggcaugcugaaucugcuggaaaagaucgccgauaaggccaaguauaagaucagccugaaagaacugaaagaguacagcaacaagaagaaugagauugaaaagaacuacaccaugcagcagaaccugcaccggaaguacgccagacccaagaaggacgaaaaguucaacgacgaggacuacaaagaguaugagaaggccaucggcaacauccagaaguacacccaccugaagaacaagguggaauucaaugagcugaaccugcugcagggccugcugcugaagauccugcaccggcucgugggcuacaccagcaucugggagcgggaccugagauuccggcugaagggcgaguuucccgagaaccacuacaucgaggaaauuuucaauuucgacaacuccaagaaugugaaguacaaaagcggccagaucguggaaaaguauaucaacuucuacaaagaacuguacaaggacaauguggaaaagcggagcaucuacuccgacaagaaagugaagaaacugaagcaggagaagaaagaccuguauauugcaaacuacaucgcucacuuuaauuauauuccucaugccgagauuagccugcuggaagugcuggaaaaccugcggaagcugcuguccuacgaccggaagcugaagaacgccaucaugaaguccaucguggacauucugaaagaauacggcuucguggccaccuucaagaucggcgcugacaagaagaucgaaauccagacccuggaaucagagaagaucgugcaccugaagaaucugaagaaaaagaaacugaugaccgaccggaacagcgaggaacugugcgaacucgugaaagucauguucgaguacaaggcccuggaaggaggagguggaagcggaggaggaggaagcggaggaggagguagcgugagcaagggcgaggagcuguucaccgggguggugcccauccuggucgagcuggacggcgacguaaacggccacaaguucagcguguccggcgagggcgagggcgaugccaccuacggcaagcugacccugaaguucaucugcaccaccggcaagcugcccgugcccuggcccacccucgugaccacccugaccuacggcgugcagugcuucagccgcuaccccgaccacaugaagcagcacgacuucuucaaguccgccaugcccgaaggcuacguccaggagcgcaccaucuucuucaaggacgacggcaacuacaagacccgcgccgaggugaaguucgagggcgacacccuggugaaccgcaucgagcugaagggcaucgacuucaaggaggacggcaacauccuggggcacaagcuggaguacaacuacaacagccacaacgucuauaucauggccgacaagcagaagaacggcaucaaggugaacuucaagauccgccacaacaucgaggacggcagcgugcagcucgccgaccacuaccagcagaacacccccaucggcgacggccccgugcugcugcccgacaaccacuaccugagcacccaguccgcccugagcaaagaccccaacgagaagcgcgaucacaugguccugcuggaguucgugaccgccgccgggaucacucucggcauggacgagcuguacucuaggggagcuggcgcuggagcgggugcaggggcuggcucuagauuccagugccggaucugcaugcggaacuucagcgaccgguccaaccugagcaggcacaucagaacccacaccggagaaaagcccuucgccugcgacauuugcggccggaaguucgccaucagcagcaaccugaacagccacaccaagauccacacuggcagccagaaaccuuuccagugcagaauuuguaugagaaacuuuagcagaagcgacaaccuggccagacacauccggacacauacuggugaaaaaccuuuugccugugauaucuguggcagaaaguuugccaccuccggcaaucugacccggcacacaaagauucaccugcggggcagccagcuaucgauugucgacgcuccugaacaacgugaaggugcuucucaaguuucuguuucuguuacuuuugaagauguugcuguucuuuuuacucgugaugaauggaaaaaacuugaucuuucucaacguucucuuuaucgugaaguuaugcuugaaaauuauucuaaucuugcuucuauggcuggaucccccaagaaaaagcgcaagguauaa

SEQ ID NO: 11034 - RNA, 3549 nt, Artificial Sequence
  Cas13a variant__Leptotrichia wadei__ERK53440.1__Cas13a
auguauaugaagauuacaaagauugauggaguaucacauuauaaaaaacaagacaagggcaucuugaaaaagaaguggaaggaccuggacgaacgcaagcagcgcgagaaaaucgaggcgcgcuauaacaaacagaucgagucgaaaauuuacaaggaauucuuucgccugaagaacaagaagcguaucgagaaagaggaagaucagaauauuaaaagcuuauacuuuuucauuaaggaguuguacuugaaugaaaagaaugaagaaugggagcugaagaauauuaaucuggagaucuuagaugacaaggaacguguuauuaagggguacaaauucaaagaggauguguauuuuuuuaaagaaggcuauaaggaguauuaucugcgcauucuguucaacaacuugauugagaaaguacaaaaugagaaucgugaaaagguacgcaagaacaaagaguucuuggaucugaaagagauuuucaagaaauacaaaaaccgcaagauugaucuguuacugaagucaaucaacaauaacaagauuaaccuggaguauaaaaaagaaaaugucaaugaggagaucuauggaauuaacccgaccaacgaccgcgaaaugacuuuuuaugaauugcugaaggagauuauugaaaagaaggaugaacagaaaucgaucuuggaggagaaauuagacaauuuugauauuacgaacuuccuugaaaauaucgaaaaaaucuucaaugaggaaacggagaucaauaucaucaaagguaagguauugaaugagcuucgugaauauaucaaagaaaaggaagaaaacaacuccgacaacaaguuaaagcagaucuacaacuuggagcuuaaaaaguauaucgagaacaacuucuccuacaaaaagcaaaagaguaaaucgaagaacggcaagaaugacuaccuguaccugaacuuccucaagaagauuauguucaucgaagaaguggaugagaagaaagagaucaacaaggaaaaauucaaaaacaagaucaacaguaacuuuaagaaccuguuuguccagcacauuuuggacuaugggaaacugcuguauuauaaggagaacgacgaauacaucaagaacacagggcaacuugaaacaaaggauuuggaguauauuaaaacuaaggaaacucuuauccgcaagauggcgguguuagucucuuuugcagcgaacagcuauuacaaccuguuugggcgcguuucuggggacauuuuggggaccgaaguaguaaaaucuucuaagacgaacgucaucaagguuggaucacacauuuucaaggaaaagauguugaauuacuucuuugauuucgaaaucuucgaugcuaacaagaucgucgagaucuuggaaucuauuucauacuccaucuauaauguacgcaauggagucgggcauuucaauaaguuaauuuugggcaaauauaagaagaaagacauuaauacuaauaagcgcaucgaagaagaccugaacaacaaugaagaaaucaaggguuacuucaucaagaaacguggcgagaucgaacgcaaaguuaaggagaaguuuuuguccaauaaccugcaauauuacuauagcaaagaaaagauugagaauuauuucgagguguacgaauucgagauucugaaacgcaagauccccuuugcuccgaacuucaaacguauuaucaaaaaaggggaggacuuguucaauaacaaaaacaacaagaaguacgaauacuucaagaauuucgauaagaauucggcggaagaaaagaaggaguuucugaaaacucgcaauuuuuuacuuaaagagcuuuacuacaauaacuuuuacaaagaguuccugaguaagaaagaagaauucgagaagauuguauuggaaguaaaggaggagaaaaagucucgcggcaauauuaacaacaagaaauccgggguaucuuuccagagcaucgaugauuaugacacuaagauuaacaucagcgauuauaucgcaucgauucacaaaaaagaaauggagcguguagagaaguacaaugaagaaaagcagaaggauaccgcaaaguacauucgugacuuugucgaagagaucuuccugacugguuucaucaauuacuuggagaaagauaaacgccugcacuucuuaaaagaagaauucucuaucuuguguaauaauaacaacaacgucguggacuucaacaucaacauuaacgaagagaagauuaaagaguuccuuaaagaaaaugauagcaagacgcugaaccuuuacuuauucuucaauaugauugacucgaagcguaucucugaguuucgcaaugagcuuguuaaguacaagcaauuuacgaagaagcguuuagaugaggagaaagaauucuuagguauuaagaucgaauuauacgagaccuuaauugaauucgugauccugacccgcgagaaacuggacacgaaaaaauccgaggaaauugacgcauggcugguagauaagcuguaugugaaggacucuaaugaguauaaggaguaugaggaaauccuuaaauuguuuguagacgaaaaaauuuuguccucuaaagaggcucccuauuacgcuaccgacaacaaaacuccuauuuuacugaguaacuucgagaaaacacguaaauacggaacgcaauccuucuuguccgagauccagagcaauuacaaguauuccaaaguggagaaggagaauaucgaagauuacaacaagaaagaggaaaucgagcagaagaaaaagucgaauaucgaaaaguuacaagauuuaaaggucgaacuucacaagaaaugggagcaaaauaagaucaccgaaaaggagauugaaaaguacaauaauaccacgcguaaaaucaaugaauacaacuacuugaagaauaaggaagaguugcagaacguauauuuguuacaugagauguuaagcgauuuacuugcacgcaauguggcuuucuucaacaagugggagcgugauuuuaaguucauuguuauugcuaucaaacaauucuuacgugagaaugacaaagaaaaagucaacgaauuucuuaauccuccggacaacuccaagggcaaaaaaguuuacuuuucaguaagcaaguauaaaaacacagucgaaaacauugacggaauucacaagaacuucaugaaccugaucuuucugaacaacaaguucaugaaccgcaagauugacaaaaugaacugugcaaucuggguuuauuuccguaauuauauugcacauuuuuuacaccugcauacaaagaacgaaaaaaucuccuuaaucagccagaugaaucuucugaucaaauuauuuagcuacgacaaaaaaguccaaaaccauauuuuaaagucuaccaagacguuauuggagaaauacaacauccagaucaacuucgagaucuccaacgacaaaaaugaaguuuucaaguauaagaucaaaaaucgcuuguauaguaagaagggcaagauguuggggaagaacaauaaauucgagaucuuagagaaugaguucuuggagaacgugaaggcaaugcuggaauauagugaauaa

SEQ ID NO: 11035 - RNA, 4158 nt, Artificial Sequence
  Cas13a variant__Clostridium aminophilum__WP_031473346.1__Cas13a
augaaguucaguaaagucgaucauacacguagugcuguugguauucaaaaggccacagauagcguucacgggaugcuguauacugaccccaaaaaacaggaagucaaugaucuugauaaacgcuucgaccaauuaaacguaaaggcgaaacgcuuguauaacguguucaaucaauccaaagcggaggaggacgaugacgagaaacguuucggaaaggugguaaaaaaauuaaaucgcgaacugaaggaucugcuuuuucaccgugaagugucucguuauaacuccauugggaacgccaaguacaauuacuaugggauuaaaucuaacccagaagaaauugucuccaaccugggaaugguggagagucuuaagggcgagcgugauccccaaaagguuaucucaaaauuacugcuuuauuaccuucguaagggacuuaagccgggaaccgacggccugcguaugauucuggaggcuucaugugguuuacguaaacuuuccggugacgaaaaggaauuaaagguuuuucuucaaacccuggaugaggauuucgaaaagaagacguuuaaaaaaaaccugauucgcucgaucgaaaaucaaaauauggccguucagccuuccaaugagggugauccuaucaucggcauuacccagggacguuuuaacucgcagaagaacgaagagaaaagcgccaucgaacgcaugaugucaauguaugcugaccugaaugaggaucaccgugaagauguauuacgcaaacugcgucgccuuaauguccuguauuuuaacguugacaccgaaaaaacagaggagccgacacuuccaggcgagguggauacaaaucccguuuuugagguguggcaugaccacgaaaaaggcaaagaaaaugaccgccaguuugcuaccuuugcaaaaauuuuaacugaagaccgugagacacguaaaaaggagaaguuggcugucaaagaggcguugaacgauuugaaauccgccauucgcgaccauaauauuauggccuaccguugcucuauuaagguuacugaacaggacaaagacgggcuguucuucgaggaucaacguaucaaucgcuuuuggauccaccacaucgagagcgcagucgagcgcaucuuagcaucgauuaaucccgaaaaauuguauaaacugcgcauuggguaucuuggagagaagguauggaaggaucuuuugaacuaucuuucuauuaaauacaucgccgugggcaaggcaguguuucacuucgcuauggaggauuugggaaaaacugggcaagacaucgaauugggcaaacugucaaacaguguaagcggcggcuuaacauccuucgauuacgagcagauucgcgcugacgaaacgcuucaacgucaguuaagcguugaaguugccuuugcagcaaauaaccuguuccgugccguuguaggacagaccggcaagaagauugagcaauccaaaucugaggagaaugaggaggacuuccuuuuauggaaagcugaaaaaauugcggaaucaauuaaaaaagaaggugagggaaacacgcuuaaaaguaucuugcaauucuucgggggagcgagcuccugggauuugaaccauuuuugcgcagcguaugguaacgagucgucugcauuaggguaugaaacuaaauucgcagacgaccugcgcaaggcgauuuacucacugcguaaugagaccuuucauuuuacuacacuuaacaaaggaucauuugacuggaaugcaaaguuaaucggugacauguuuagccacgaggcugcaacggggaucgcaguagaacgcacgcgcuuuuacucgaacaauuuaccgauguuuuaccgcgagucggacuugaaacgcaucauggaccauuuauacaauaccuaccacccccgugcgucccaaguuccuaguuuuaacucaguuuucgugcgcaagaauuuccgccuguuucugaguaauacgcugaacaccaauaccucauucgacacugaaguauaccaaaagugggagagcggugucuauuaucuguucaaggagaucuauuauaacaguuucuuaccaaguggugacgcccaccaucuuuucuuugaaggguuacgucgcauccguaaagaagcugacaaucugccgaucguggguaaagaagcuaagaaacgcaaugcgguucaagauuuuggucgucguugugacgaacuuaagaaucuuucucugagcgccauuugccagaugauuaugaccgaauauaaugagcaaaauaauggaaaucguaaggucaagucuacacgugaagauaaacguaagccagauauuuuccagcacuauaaaaugcuguuacugcgcaccuugcaggaggcuuuugcgaucuauauucgucgcgaagaguucaaguuuaucuucgacuugccaaaaacccuuuaugugaugaaaccagucgaagaguucuugccuaauuggaaauccgggauguucgauaguuuaguggaacgcguaaagcagucgcccgacuuacagcgcugguacguguuguguaaauuuuuaaaugggcguuuguugaaucaauuaucagggguaauucgcucauauauccaguuugcaggagauauccaacgccgcgcaaaagcuaaucauaaccgcuuguauauggauaacacgcagcgcguugaguauuauucaaacgucuuagaagugguggauuucuguauuaagggcacuucucgcuucuccaacguguucucugauuauuuccgcgacgaagaugcauaugccgauuaccuugacaauuacuugcaauuuaaagaugagaaaaucgcggaggucuccaguuuugcagccuugaagacauuuuguaacgaagaggagguuaaagcaggaauuuacauggauggagaaaaccccguuaugcagcgcaauaucguuauggccaaacuuuucgggccggaugagguucugaaaaaugugguuccgaagguuacgcgugaggagaucgaggaauauuaccaguuagagaaacagauugcuccauaucgccagaauggauauuguaaauccgaggaggaccaaaagaaacuucuucgcuuucagcguaucaaaaaucguguugaauuccagacgaucaccgaguucagcgagauuauuaaugagcuguuaggacagcugauuuccuggagcuucuuacgugaacgcgacuugcuguacuuucagcugggcuuucacuaccuuugucuucacaaugacacggagaagccugccgaauacaaggaaauuucucgcgaggacggcacaguuauccguaaugccauuuugcaucagguggcugcuauguauguggguggauugcccguuuacaccuuagccgacaagaaguuggccgcauucgagaagggcgaggcggauugcaaacugagcauuucgaaagauacagcaggggccgguaagaagauuaaggauuuuuuccgcuacaguaaauacguauugauuaaagaucguaugcugaccgaccagaaucagaaauacacaaucuacuuagcgggucuggaguuguucgagaacacggaugaacaugacaauauuacggacguacgcaaguacguagaucauuuuaaguauuaugcuacgagugaugaaaacgccaugucuauucuugaucuguacagugagauucaugaucguuucuucacguaugacaugaaguaucaaaagaacguagccaacaugcuugagaauauccuuuuacgucacuucgugcuuauccguccugaguuuuucacugguaguaagaaagucggggaaggaaaaaagauuacauguaaggcucgugcacaaauugagauugcagaaaacgggaugcguucagaggacuuuacguauaaacuguccgaugggaaaaagaacauuagcaccuguaugauugcggcacgcgaccagaaguaucugaauacggucgcgcguuuacuguacuauccacacgaggcaaagaagucgaucgucgacacgcgcgaaaagaaaaacaauaagaagacaaaccgcggugacggcaccuucaauaagcagaaagguacugcacguaaggaaaaggauaaugggccccgcgaauucaacgauacgggcuuuagcaauacgccauuugcagguuucgaccccuuucguaauagcuaa

SEQ ID NO: 11036 - RNA, 4035 nt, Artificial Sequence
  Cas13a variant__Eubacterium rectale__CVRQ01000008.1__Cas13a
augcugcgucgugauaaggaagugaaaaagcuuuauaacguuuuuaaucagauccaggucgguacgaagccuaaaaaauggaauaaugaugaaaaauugucgcccgaagagaaugaacgucgcgcucaacagaaaaauaucaagaugaaaaacuacaaauggcgugaagccugcucaaaguauguugaguccucgcaacgcauuaucaacgauguuauuuuuuacucuuaucguaaagcgaaaaauaaguuacgcuacaugcgcaagaaugaggauaucuugaagaagaugcaagaggcagagaaguuguccaaguucaguggcggcaaguuggaggauuuugucgcauacaccuugcguaagucguuaguagucuccaaguacgauacacaagaguucgauaguuuagcugcuaugguuguauuccuugaguguauugguaaaaauaacaucuccgaucaugagcgcgagaucguuuguaaacugcuugaauuaauucguaaggacuuuaguaaguuggauccaaauguuaaggggucacaaggugcaaacauuguccgcaguguccgcaaucagaauaugauuguacaaccccagggggaucguuuccuuuucccccagguguaugcgaaggagaaugagaccgucacuaauaaaaauguagaaaaagaagguuuaaacgaguuccuucugaauuacgcgaaucuugacgacgagaaacgcgcggaaaguuugcgcaaauugcgccguauucuugacguuuacuuuucugcaccaaaccacuaugaaaaggacauggauaucacauuaagcgacaacauugaaaaggagaaguucaacgugugggagaaacacgaauguggcaaaaaggagacaggcuuauuuguggacaucccagauguauuaauggaagcagaagcagagaacauuaaauuagacgccgugguagagaaacgugagcguaaagucuuaaacgaucguguacguaaacaaaacaucaucugcuaccgcuauacgcgcgcagugguggagaaauacaauuccaacgagccuuuguucuuugagaauaaugccaucaaccaauacuggauccaccauauugaaaacgccgucgaacguauucuuaaaaacuguaaagcagguaaguuguucaagcugcgcaagggguaucuugcagagaaagucuggaaagaugccaucaacuuaaucuccaucaaauacauugcguuagggaaggccguauacaauuuugcguuagacgacaucuggaaggacaagaaaaauaaggaacuggggaucguggaugagcgcauccguaacggcaucacuaguuuugauuaugaaaugaucaaggcgcacgagaacuugcaacgugaacuugcuguggacauugcguuuucggugaacaaccuugcacgcgcuguuugugacaugaguaacuuggguaauaaagaaucggauuuccuguuguggaaacgcaacgacauugccgacaaguuaaagaacaaggaugacauggcuagcguuagcgcuguacugcaguuuuucgguggcaaguccagcugggauaucaacauuuuuaaagaugccuauaaagguaaaaagaaauacaauuacgaaguucguuuuaucgacgaucugcgcaaggcgaucuauugugcacgcaacgagaauuuccauuucaagacagcguugguuaacgaugaaaaguggaauacugaauuguuuggcaaaaucuucgaacgcgagacggaguuuugccuuaauguggagaaagaccgcuucuacucgaacaacuuauacauguucuaccagguaagugaacugcgcaacaugcuugaucaccuguauagucgcucaguaagucgcgccgcccaagugccuucuuacaauucuguaauuguucgcacugcuuuccccgaguauaucacgaauguauuaggauaucagaaaccaagcuacgaugcugacacguuagggaagugguacagcgccugcuacuauuuguugaaagaaaucuauuacaauuccuucuuacagucggaucgugcguugcagcuuuuugagaaaucaguuaaaacccugucaugggacgauaaaaaacaacaacgugcgguagauaauuuuaaggaucacuuuuccgacauuaaaucagccugcacuaguuuagcccaggugugucagauuuauaugacggaguacaaccagcagaacaaccaaauuaaaaagguucgcucaucaaaugacucuauuuucgaucaaccagucuaccaacauuacaaggucuuauugaagaaggcgauugcaaacgcuuuugcggacuauuugaagaauaacaaggacuuauucgguuuuaucggcaaaccguucaaggcuaaugaaauccgugagauugacaaagaacaguuucugcccgacuggacuagucgcaaauacgaagcauuauguaucgagguuagcggaagccaagaauugcagaaaugguacaucguagguaaauucuugaacgcccguaguuuaaacuugaugguggguuccaugcgcuccuauauccaauacgucacagauauuaaacgccgugcagcaucuauugguaaugaauugcauguaucgguacaugauguagaaaagguagagaagugggugcaggucaucgagguuuguuccuuacuggccucgcguacuaguaaucaguucgaagacuacuuuaacgauaaggaugacuacgcacguuacuuaaagucauacgucgauuuuucaaacguugacaugcccuccgaguacucagccuuaguggauuuuagcaaugaggagcaaucugauuuguauguggacccaaagaacccuaagguaaaucgcaacaucgugcacucgaaacuguuugcagcagaucauauuuuacgcgacaucgucgagccagucagcaaggauaauauugaagaauuuuacucacagaaggcggagauugcuuauuguaaaaucaaggggaaagagaucacggcggaggagcaaaaagccguguugaaauaucaaaaacugaaaaaccguguggaacugcgugauaucguagaguauggcgaaauuaucaacgaguuguugggacagcugauuaauuggagcuucaugcgugaacgugacuuguuauacuuccaacuuggauuucauuacgacuguuuacgcaacgauaguaagaaaccugaagguuauaagaauauuaaaguggacgagaauucuaucaaggacgcuaucuuauaccagaucauuggaauguaugucaaugggguaacuguauacgcgccugaaaaagauggggauaaauugaaggaacagugugugaaaggaggagugggagugaaaguaagugcguuccaccgcuauucuaaauauuuaggacugaaugaaaaaacgcuuuacaacgccggucuggagauuuucgaagucguagcggagcaugaggacauuaucaacuuacgcaacggcaucgaucacuuuaaguacuauuugggcgauuaucguucuauguugucgauuuacagcgaagucuucgaucgcuuuuucacuuaugacauuaaauaccagaaaaauguauugaauuuacugcaaaauauccuuuugcgccacaaugucaucgucgagccgauuuuggagucggguuucaagaccauuggggagcagacuaaaccaggugcaaaguugucgauucgcaguauuaaaagugacacauuccaauacaagguuaaaggcgggacauugauuacagacgcuaaggacgagcguuaccuugaaacgauucguaagauucuguacuacgcugaaaaugaagaggauaaccugaaaaagucaguggucguuacaaacgcugacaaauacgagaaaaauaaggagucagacgaccagaauaaacagaaagagaaaaagaauaaggacaauaaggggaaaaagaacgaggagacaaaaucugacgccgagaaaaacaauaacgaacgcuuaucauacaaccccuuugcgaaucuuaacuuuaagcugagcaacuaa

SEQ ID NO: 11037 - RNA, 3858 nt, Artificial Sequence
  Cas13a variant__Herbinix hemicellulosilytica__CRZ35554.1__Cas13a
augaaguugacgcgucgccgcaucaguggcaauucagucgaccagaagauuacagcugcguuuuaucgugauaugucgcaaggguuauuauauuaugauucggaggacaaugacuguacggacaaggucaucgaaaguauggauuucgaacgcucuuggcguggacgcauucugaagaacggcgaggaugauaagaauccguuuuacauguucguuaaagguuuaguugguuccaacgauaagaucgugugcgaaccuaucgacgucgacucagacccugauaacuuagauaucuugauuaacaaaaaucugacgggguucggacgcaacuugaaagcaccugacaguaacgauaccuuagaaaaucuuauccgcaaaauccaggccggcauucccgaagaagagguucuuccggagcugaagaaaauuaaagagaugauccagaaagacaucguuaaccgcaaagagcaguugcuuaaauccaucaaaaacaaccguauuccuuuuucauuggaagguuccaagcuggucccuuccaccaaaaagaugaaguggcuuuucaaguugauugacguuccuaauaaaaccuucaaugaaaaaauguuggagaaguacugggagaucuacgacuaugacaagcuuaaggcgaauaucacgaaccgccuggacaaaacggauaagaaggcacguucaauuucgcgugcgguaagcgaggaguuacgugaguaccauaaaaacuugcgcacaaacuauaaucgcuucguaucuggagaccguccagcagccgggcuugacaauggggggagugcuaaauauaaucccgauaaggaggaguucuuauuguuucuuaaagaaguugagcaguacuucaagaaauacuucccagucaagagcaagcauucgaacaaguccaaagacaaaucauugguugauaaguacaaaaauuauugcaguuacaaaguggucaagaaagaggucaaccgcagcaucaucaaucaauugguggcuggacuuauucagcaggguaagcuucuguauuacuucuacuauaacgauaccuggcaggaggauuuccugaauuccuacggucuuaguuauauucagguugaggaggcauuuaaaaagaguguaaugaccagucuuucguggggaaucaaccgucugaccucguucuuuaucgacgacucgaacacugugaaguuugaugauaucacaacgaaaaaggcuaaggaggcgauugagucuaauuauuucaacaaauuacgcacaugcucccguaugcaggaccacuucaaagagaaauuggccuucuuuuacccgguguaugugaaggacaagaaggaucgcccggaugaugauaucgaaaacuuaauuguacugguuaagaacgccauugagagcgugagcuauuugcgcaaucgcacguuucacuuuaaagagagcuccuuauuggagcugcuuaaagaguuagacgauaaaaauucuggucaaaauaaaaucgacuauagcguagccgcugaauuuauuaaacgcgauaucgagaacuuguaugacgucuuccgugaacagauccgcucacuugguauugcugaguacuacaaggcggacaugauuucggacuguuuuaagacaugcggguuagaauucgcgcuuuauucgccaaaaaauucguugaugcccgcuuuuaagaacguuuauaaacgcggagcaaaucuuaacaaggcguauauucgcgauaaagggccaaaggaaacaggagaccagggucagaacucguacaaagcuuuggaggaauaucgugagcuuacaugguauauugaggugaagaauaacgaccagucguacaacgccuacaagaauuugcuucaacugauuuauuaucaugcguuucuuccggagguucgugaaaaugaggcucuuaucacugacuucauuaaccgcacuaaagaguggaaucguaaggaaacagaggagcgucugaacacuaaaaacaauaaaaaacacaagaauuucgacgagaaugacgauauuacgguaaauacguaucguuacgaaucuauuccggauuaccagggggaaucccuugaugauuaucuuaagguguuacagcgcaagcaaauggcgcgugcgaaggagguaaaugagaaggaggagggcaacaauaacuauauccaauucauucgugacgucguaguaugggcguucggggccuacuuggaaaacaagcugaagaauuauaagaacgaacugcaaccaccguugagcaaagagaacauuggcuuaaaugauaccuuaaaggaauuguuucccgaagaaaaaguaaagucaccauuuaauaucaagugccguuucuccauuaguacauuuaucgacaacaaagguaaguccaccgauaauaccucggccgaggccgucaagacugauggcaaggaggacgaaaaggacaaaaagaauauuaaacgcaaagacuugcuuugcuuuuaccuguucuuacgcuugcuugaugaaaacgaaauuugcaaauuacaacaccaauuuauuaaauaccguugcaguuuaaaagagcgucguuuuccagguaaccgcaccaaacuggagaaggaaacugaacuuuuggccgagcuggaagaacugauggaacugguacguuuuacgaugccaucaauuccugaaaucucugcaaaggcggaaucagguuaugacacaaugauuaagaaguauuuuaaagacuucaucgagaaaaaagucuuuaagaauccgaagacguccaaccuguacuaccacuccgacucuaaaacuccggucacccgcaaauauauggcucugcugaugcguucugcgccuuugcaucucuacaaggauaucuucaagggcuacuauuugaucacuaagaaggaguguuuggaguauauuaaauuaagcaacaucauuaaagacuaucaaaacucauugaaugaauugcacgagcagcuggagcgcauuaaauuaaagagugagaaacaaaacgggaaagacucucuguaucuugacaaaaaggacuucuauaaaguaaaggaguacgucgaaaauuuagaacaaguggcgcguuacaagcacuugcagcacaaaaucaacuucgaaagcuuauaccguauuuuucguauucacguggacaucgcugcgcguauggucgguuauacccaagacugggagcgugauaugcacuuucuuuucaaggcguuggucuauaauggcguacuugaggagcgccguuuugaagcaaucuuuaacaauaacgaugacaacaacgacgggcguaucguaaaaaagauccagaauaacuuaaauaacaagaaccgcgaauuaguaucuauguuauguuggaauaaaaagcugaacaagaacgaauuuggugcuauuauuuggaagcguaacccuaucgcccaucugaaccacuuuacacaaacggaacaaaacucaaagucgagccuugaaucucugaucaacucgcugcgcauccuguuagcguacgaccguaaacgucaaaacgcugugacaaagacuaucaaugaccuucuguuaaacgacuaucacauccgcauuaagugggaagggcgcguggaugaagggcagaucuacuuuaauaucaaggaaaaggaagacaucgagaacgagccuauuauccacuugaaacaccugcauaaaaaggacugcuacauuuacaagaacagcuauauguucgacaagcaaaaggaguggauuuguaauggcauuaaagaagaaguuuaugacaaguccauucuuaaguguaucggaaacuuguucaaguuugacuaugaggacaaaaacaaauccucagcaaauccuaagcacaccuaa

SEQ ID NO: 11038 - RNA, 4314 nt, Artificial Sequence
  Cas13a variant__Lachnospiraceae bacterium__WP_022785443.1__Cas13a
augaagaucaguaaaguacgcgaagaaaaccguggggccaaauugacugugaacgccaagacugcuguaguguccgagaaccguucgcaagaagggauccuguauaaugacccaagucguuacgguaaaagccgcaaaaaugacgaggaucgugaccgcuacaucgagucccgucuuaagucuucugggaaauuauaccgcauuuuuaaugaggacaagaacaaacgcgagacagacgaacugcaaugguuccuuagugagaucgugaagaagaucaaucgucgcaaugguuugguauuaucggauaugcuuaguguggacgaccgcgcauucgagaaagccuucgaaaaguaugcagaguuaucguauacgaaucgccguaauaaaguuucugguagcccggcguucgagaccugcggaguagaugcagcaacagcugaacguuuaaaaggcauuaucucggaaaccaacuuuaucaaccguaucaaaaacaauaucgacaacaaagucucggaggacauuaucgaucguauuaucgcuaaguacuugaagaaaagcuugugucgugagcgugucaaacguggguuaaagaaacuuuuaaugaaugccuucgacuugccuuacagugacccugacaucgaugugcaacgcgauuuuauugauuacguuuuagaggauuucuaccauguucgugccaagucacaagugucucguucgaucaaaaacaugaauaugccggugcagcccgaaggcgaugguaaguuugcgaucacaguaaguaagggugggacggaaucggggaacaaacgcucugccgaaaaagaagcauucaaaaaguuccugagugauuacgcgucgcuggaugaacguguucgugacgacaugcuucgucgcaugcgccgccuggucgucuuguacuuuuacggaucagacgauagcaaauuaucagauguuaacgaaaaauucgacguaugggaggaccaugcugcccgccgcguagacaaucgcgaguucaucaagcuuccguuggagaauaaacuugccaacggcaagaccgauaaagaugcggaacguauccguaagaacaccguuaaagaacuguaucguaaccaaaauauuggaugcuaucgccaggcuguuaaagccguagaggaggacaacaacggucgcuacuucgacgacaagaugcugaacauguucuuuauucaccgcaucgaguacgguguggaaaagauuuacgccaauuugaaacaagucacggaguucaaggcccgcacuggguaucuuucagagaaaaucuggaaagacuugaucaauuacauuuccauuaaauacaucgcuaugggcaaggcagucuacaauuacgccauggaugagcugaaugccucagacaaaaaggagaucgagcugggcaagaucagugaagaauauuuguccgggaucaguucguuugacuaugaauugaucaaagccgaagagaugcugcaacgcgagaccgcuguauauguugcuuucgcggcucgccacuuguccucccagaccguugaacuggauuccgagaacuccgacuuccuucuuuugaagccaaagggaacuauggacaagaacgauaaaaacaaguuagccuccaacaacauucuuaauuuucuuaaggacaaggaaacacuucgcgauaccauuuuacaguacuuuggcggccacagucuguggaccgacuuuccguuugacaaauacuuggccggcgggaaagacgacgucgacuuccugacagaccuuaaagaugugauuuacuccaugcguaaugauaguuuucacuaugcuacugaaaaccacaacaauggaaaauggaauaaggaauuaauuagugcaauguuugaacaugaaacagagcguaugacaguagucaugaaagauaaauucuacucgaauaaucuuccuauguucuauaagaaugacgacuugaagaaauugcugaucgauuuguacaaggauaacguagagcgugcgagccaggucccaucuuuuaacaaggucuucgugcgcaagaauuuuccugcuuugguucgcgauaaagacaacuuggggauugaauuagaccuuaaggcggacgcggauaaaggugagaacgaguuaaaauucuacaacgcucuuuauuacauguuuaaagagaucuacuauaacgcguucuuaaaugauaagaaugugcgugaacguuuuauuacuaaggcgacgaaaguggccgauaacuaugaucgcaauaaggagcgcaaccuuaaagaccguauuaaguccgcggggucggaugagaaaaaaaaguuacgugaacagcugcagaauuacauugcugagaaugacuucgggcagcguaucaagaauaucgugcaggucaauccggauuauacccuggcucaaaucugccaacuuauuaugacggaguauaaucaacaaaacaacgggugcaugcagaaaaagucugcugcccgcaaagacaucaauaaggauaguuaccagcauuacaagaugcugcuuuugguuaauuuacgcaaagcauuuuuggaauuuauuaaggagaauuaugcuuuuguuuugaaacccuauaaacacgaccuuugugauaaagccgauuucgugccagauuucgccaaauacgucaaacccuacgcuggcuugaucagccguguagcaggaucaagugagcugcaaaagugguacaucgugagccgcuucuugucuccggcacaggccaaucacaugcuuggguuccugcacucguacaagcaguacguaugggauauuuaccgccgcgcauccgaaaccgguacagagauuaaccacucuaucgcagaggacaagauugcugggguugacauuaccgacgucgacgcagugaucgauuuaucggugaaauugugcggaacaaucucuagcgagauuucggauuauuucaaggaugacgaggucuacgcggaguacaucucaucauauuuagauuucgaauacgauggugguaauuacaaagacucgcugaaccguuucuguaauucagacgcaguaaaugaccaaaaaguggcacuguauuaugacggcgaacacccgaaauugaaucguaacauuaucuugucgaaacuuuacggagagcgccguuucuuggagaaaaucacugaccgcguuucucguucagauauuguggaguauuacaagcugaagaaggagacgucgcaguaucagacgaaagggauuuucgauagugaggacgaacagaagaauauuaagaaguuucaggagaugaaaaacaucguggaauuucgugaucugauggauuacucggagaucgcggacgaauuacaaggacaacugaucaacuggauuuaucuucgugaacgugaccugaugaacuuccaacugggguaucauuacgccugcuugaacaacgacucaaauaagcaagcuacuuauguaacucuugauuaccaagguaaaaaaaaccgcaagauuaacggugcgauuuuauaucagauuugugcaauguauauuaauggacugccgcuuuacuacgucgauaaagacaguucggaguggacggugagcgacgguaaggaauccacgggagccaagauuggugaauucuaccgcuaugcaaaguccuuugaaaauacgucugacugcuacgcuucgggcuuagagaucuucgagaauaucagugagcacgacaacaucacggaauuacgcaacuacauugaacauuuucguuacuacagcucuuuugaccguuccuuuuuggggaucuauucagagguguuugaucgcuuuuucacauacgacuuaaaguaucgcaaaaacguaccuaccaucuuguauaauauuuuacugcaacacuuuguuaauguccgcuucgaguucguaagcggcaaaaaaaugauuggcauugacaaaaaggaccgcaagauugccaaagagaaggaaugcgcucguauuacaauccgcgaaaagaacggugucuacucggagcaguucacuuacaaguugaagaaugggaccguguaugucgaugcgcgugacaaacgcuaccugcaguccauuauucgucuuuuguuuuaccccgaaaaggucaacauggacgaaaugaucgaaguuaaggaaaagaagaagccgagugacaauaauacgggaaagggcuauagcaaacgcgaccgccagcaggaucguaaagaauaugacaaguacaaagaaaaaaagaaaaaggaggggaauuuccuuucagguaugggaggcaauaucaacugggacgagauuaacgcucaacuuaagaacuaa

SEQ ID NO: 11039 - RNA, 3156 nt, Artificial Sequence
  Cas13a variant__Listeria newyorkensis__WP_036091002.1__Cas13a
augaaaauuaccaagaugcgcguggauggucguacgauugugauggaacguacuucgaaagaaggacagcugggcuaugaaggcaucgacgggaacaaaacgacugagauuauuuucgauaaaaagaaggaaucuuuuuacaagagcauuuugaacaaaaccguccgcaaaccggacgagaaagagaaaaaucgccgcaaacaagcaauuaacaaagcaauuaauaaggagaucacggaguuaaugcuggccgugcuucaucaagaggugccuucgcaaaaacugcacaacuuaaagucacuuaacacggagucguuaacgaaauuauucaagccuaaguuccagaauaugauuaguuacccuccuuccaaaggcgcugagcaugugcaguuuugcuuaacagauauugcgguuccggcaauccgugaucuugaugagauuaagccggauugggguaucuuuuuugaaaaacuuaagccuuacaccgauugggcugagagcuacauccauuacaaacaaacaaccauucaaaagucgauugagcagaacaagauucaaucaccggacuccccgcgcaaguugguauugcaaaaauaugucacugccuuccugaauggugagccccuuggauuagauuuggucgcuaagaaguauaaauuagccgaccuggcugagaguuucaaacuggucgaccuuaaugaggauaaaucagcgaauuacaaaauuaaagccugucuucagcagcaccagcguaacaucuuggaugaguuaaaggaagauccagaacuuaaccaauaugguauugaagucaaaaaguacauucagcguuacuucccuauuaaacgugcaccaaaucgcuccaaacaugcacgugcagacuucuuaaagaaagaauuaauugaaucgacaguggaacaacaauucaaaaacgcggucuaucacuacguauuggaacagggaaaaauggaagcauacgaacuuacugacccuaaaacuaaagaucuucaggacauucgcagcggagaagcauucucauuuaaauucaucaacgcgugcgcauucgcaagcaacaacuuaaagaugauucuuaauccggagugcgaaaaagacauucugggcaaaggcaacuucaaaaaaaaccugcccaauucaacgacgcguucugacgucguaaaaaaaaugauuccuuuuuucagugacgaacugcaaaacgugaauuuugacgaggccaucugggccauccguggcucaauccaacaaauccguaaugaaguguaucacuguaagaagcauucuuggaaaucgauccuuaagauuaaaggcuuugaauuugaaccgaauaacaugaaauacgcagauuccgauaugcaaaagcuuauggacaaagacaucgccaagauuccggaguuuauugaggaaaaauugaaaucaucaggcguagugcguuuuuaccgucaugacgagcugcaaagcauuugggaaaugaagcaagguuucucgcugcuuacuacgaacgcgccguucgugcccucguuuaaacgcguguaugcgaaggggcaugauuaucaaacaagcaagaaccgcuacuacaaucuggaccuuacaaccuucgacaucuuggaauacggagaagaagacuuucgugcucgcuauuucuuaacuaagcuuguauacuaucaacaguucaugccuugguuuacugccgauaauaacgccuuucgcgacgcagccaauuuuguguuacgcuuaaauaaaaaucgucagcaggaugcgaaagcauucaucaacauccgcgaaguugaagagggagagaugccgcgcgauuacauggguuauguucagggccaaaucgcgauccaugaagauucgauugaggauacuccuaaccauuucgaaaaguuuaucagucaaguuuuuauuaaagguuuugaccgucacaugcguuccgcgaauuugaaauucaucaagaauccacgcaaucaaggccuugaacagucggagauugaagaaaugucguucgacaucaagguagagccuuccuuucugaaaaacaaggaugacuacauugcuuuuuggauuuuuuguaaaaugcuggaugcccgccacuuaucagaauuacguaaugagaugauuaaguaugauggacacuugacgggagaacaagagaucauugguuuagcguuacuggguguugacagccgcgagaacgacuggaagcaguuuuuuuccucagagcgcgaauaugagaaaaucaugaagggcuacgucguggaagaacuuuaucagcgcgagccauaucgucagucagaugggaagacgccuaucuuauuccguggcguggaacaggcacgcaaauaugguacagaaaccgugauucaacgccuuuuugacgccaaucccgaauuuaaggucagcaaauguaacuuagccgagugggagcgccaaaaagagaccauugaagagacaaucaaacgccgcaaggaauugcacaaugaaugggccaagaacccuaagaaaccgcagaacaaugcguucuucaaagaguauaaagaaugcugcgaugcuaucgaugccuacaauuggcauaagaauaaaaccacauuggccuauguaaaugaacugcaucacuuacuuaucgaaaucuuggggcgcuauguuggcuauguugcgaucgcggaucgcgauuuccaguguauggccaaucaauacuuuaagcacucaggcauuaccgaacgugucgaauacuggggagacaaucgccuuaaaagcauuaaaaaguuggacacuuuucugaagaaagaaggucuuuuuguaagugagaagaacgcccgcaaccauauugcgcauuuaaacuaccugucauuaaagucugaguguacucuuuuauaccuuuccgagcgcuuacgugagaucuucaaauacgaucguaagcuuaaaaacgcaguuucaaaauccuuaauugacauucuugaucgccaugggaugucaguugucuuugccaaccuuaaagaaaacaaacaccgccugguuaucaagaguuuagaaccaaagaaacuucgucauuuaggugggaagaaaaucgauggcggauacauugagacuaaccaaguaagcgaggaguauugcggaaucgugaaacguuugcuugaaauguaa

SEQ ID NO: 11040 - RNA, 3363 nt, Artificial Sequence
  Cas13a variant__Listeria seeligeri__WP_012985477.1__Cas13a
auguggaucagcaucaagaccuuaauccaucaccuugggguccuguucuucugcgacuauauguacaaucgccgugagaagaaaauuauugaagucaagacgaugcguauuaccaaaguagaaguggaucgcaaaaaggugcuuaucucccgcgauaagaaugguggaaaacugguuuacgaaaaugagaugcaggauaauacggagcagaucaugcaccacaaaaaguccucauuuuacaagucugucgucaauaaaacaauuugccguccagagcaaaaacaaaugaaaaaguuagugcaugggcuuuuacaggaaaacucucaagagaagaucaaaguaucggauguuaccaagcuuaacaucucgaacuuucuuaaucaucgcuucaaaaaaagccuuuacuacuucccggaaaauucuccggauaaaagcgaggaguaccgcauugagauuaauuuaagucaguugcuugaagauucgcugaagaagcagcaggggaccuuuauuugcugggagagcuuuucaaaagacauggagcuguacauuaauugggccgaaaauuauauuucgagcaaaaccaaacuuauuaagaaaucuauucguaauaaucguauccagucuacggaaagccguuccggacaguuaauggaucgcuacaugaaagacauccugaacaagaauaagccuuuugacauucagucagucucggaaaaguaccaguuggaaaaauuaacuucggcacugaaggcuaccuuuaaggaggcuaagaagaaugacaaggagauuaacuauaaauuaaagagcacgcugcagaaccaugaacgccagaucaucgaggaauuaaaagagaacuccgaacuuaaccaauucaacaucgaaauccguaagcaucuugagaccuacuuccccaucaaaaagaccaaccguaagguaggcgacauucguaacuuagagauuggggaaauucagaaaaucgucaaccaucguuugaagaauaagauuguccaacguauccuucaggaaggaaagcuugcgucguacgagauugaaucaacgguaaacucuaacucguuacagaagaucaagauugaggaggcguucgcacuuaaguucauuaaugcuugucuuuuugccucgaacaauuuacguaacaugguuuacccagucugcaaaaaagacauuuugaugauuggggaguuuaagaacuccuuuaaggaaaucaagcauaagaaguucauucgucaguggucccaauucuuuagccaggagaucacugucgaugacauugaguuggccucauggggguuacgcggagcaauugcuccgauucguaacgaaaucauucauuuaaagaaacauagcuggaagaaauuuuucaacaaucccacuuucaaagucaaaaaaucuaagaucauuaacggaaagaccaaggauguuaccagugaauuccuuuauaaagaaacacuguuuaaagauuacuuuuauucugaauuggauucugugcccgaguugaucaucaauaagauggaaucuucgaaaaucuuggacuauuacucaagcgaucagcuuaaccaggucuucacaauucccaauuucgaguugagcuuguugacaucggccguuccuuuugcgccauccuuuaaacguguauaucuuaaagguuuugacuaucagaaccaggaugaagcacagccugacuacaauuugaagcugaauauuuacaaugagaaagcuuucaauagugaagcuuuucaggcucaauauagcuuauucaaaaugguuuauuaucaaguguuccuuccgcaguucaccacuaauaacgaucuuuuuaaaagcucagucgauuucauuuugacuuugaacaaagaacgcaaaggguacgcgaaggccuuucaggauauucgcaaaaugaauaaagacgaaaaaccuucugaguacaugucguacauucagucgcagcugauguuguaccagaagaagcaggaagagaaagaaaaaaucaaccauuuugagaaauuuaucaaccaaguguucauuaagggguuuaacucguuuauugagaaaaaccgucugacuuauaucugucauccaacaaagaauacugucccggagaaugauaacauugaaaucccauuucacacggauauggaugauucaaacaucgcauucuggcugaugugcaaauuacuggaugcgaaacaacuuagcgaauuacguaaugagaugauuaaguucuccuguucuuuacaaucuaccgaggaaauuuccacauucacuaaagcucgugaagugauuggucuggcuuuacuuaacggggagaaaggcugcaaugacuggaaagaguuauuugacgauaaagaggcauggaagaaaaacaugucacuguaugugagcgaggaacuucuucagucauuacccuauacccaggaggaugggcagacgccaguuaucaaccguuccaucgaucugguuaagaaauacgguacggagaccaucuuagagaaauuguuuaguucaucagaugacuauaaagucucagcgaaggacaucgcaaaguuacacgaguacgacguaacugaaaagaucgcacaacaagagaguuuacauaagcaguggaucgaaaagccugggcuugcucgcgacucggcauggaccaaaaaauaccagaauguaauuaaugauauuucgaauuaccagugggcuaagacuaagguggagcuuacccagguucgucaccuucaucaguugaccaucgauuuauugucccgcuuagcuggguauaugucuauugcagaucgcgauuuccaguucuccaguaauuauaucuuggaacgugaaaauagugaguaccgcguaacgagcuggauccuuuuaucugaaaacaagaacaagaauaaguauaaugacuaugaacuguauaaucuuaagaacgcuucaaucaaagucagcagcaaaaaugacccucagcuuaaaguugauuuaaaacaguugcguuuaacguuggaguacuuagagcuuuucgacaaccgcuuaaaggagaagcguaauaauauuucgcacuucaacuaccuuaacggacagcuugguaacagcaucuuggaauuauucgacgacgcccgcgauguacugucuuaugaucgcaaauuaaagaaugccgucucgaaaucauuaaaagaaauccuuucuucacacgguauggaaguaacguuuaagccgcuuuaucaaacaaaccaccauuugaaaaucgacaaguugcaacccaaaaagauucaucacuuaggugagaaaaguacgguuaguucgaaucaaguaucuaaugaauacugccaguuaguucguacuuugcuuaccaugaaauaa

SEQ ID NO: 11041 - RNA, 3465 nt, Artificial Sequence
  Cas13a variant__Paludibacter propionicigenes__WP_013443710.1__Cas13a
augcgugugucgaaagugaaaguuaaagaugggggcaaagacaagauggucuugguccaucguaagacgaccggugcccaacuuguuuauucagggcagcccguuagcaacgagacgucuaauauucugccagaaaaaaagcgccagucauucgaccuuagcacccugaacaaaacaauuaucaaauucgauacugcgaaaaagcaaaaguuaaauguggaccaguauaagaucguagaaaagaucuucaaguaucccaagcaggagcugcccaagcaaauuaaagcagaggagauccugccguuuuugaaucacaaauuccaggagccagucaaguauuggaaaaacgggaaggaagagagcuucaauuuaacauuauugaucgucgaggcaguccaagcacaggacaagcguaaacuucagcccuauuaugacuggaagaccugguacauccaaacuaaaagcgauuuacugaagaagaguaucgagaacaaucguaucgauuugacugagaacuugucaaagcgcaagaaggcauuguuggccugggagacagaguucacagcauccgguucaaucgaccugacgcauuaccauaaggucuauaugacggauguucugugcaaaauguuacaagauguuaagccgcugacagaugauaaagggaagaucaacaccaaugcguaucaucgugggcuuaagaaagcccugcagaaccaccaaccagccaucuuuggaacacgcgaggugccuaaugaggcuaaucgugcagacaaucaguugagcauuuaucauuuggaggucgugaaguaucuugagcacuauuuuccaauuaaaacuucgaaacgccgcaauaccgccgacgauaucgcucauuauuuaaaggcacagacguugaagacaacgauugaaaagcagcugguaaacgccauccgcgcgaacaucauccaacaaggcaaaaccaaucaucacgaguugaaagcggacacaacaucgaaugauuugauccguauuaaaacuaacgaagccuucgucuuaaacuuaacugguaccugugcguuugcagcgaacaauauucgcaacaugguggacaacgagcaaacuaacgacauccugggaaagggggacuuuaucaagagcuuacugaaggacaauacgaacagccaauuguacucguuuuuuuuuggugaaggauuauccacgaauaaggcagagaaagagacgcaacuuugggguauccguggggcuguucaacagauccgcaauaauguaaaucauuacaagaaagacgcccuuaaaaccguguucaacaucucaaauuucgagaaucccaccauuacugacccgaaacaacagacuaacuaugcagacaccaucuauaaagcgcgcuucaucaaugaauuggaaaagaucccugaagccuuugcacagcagcuuaaaacuggcggugcugucuccuauuacacuaucgaaaaccugaaaucauuauugacuacguuucaguuuucgcugugucguagcacgauuccauuugcaccugguuucaaaaagguuuuuaauggaggaaucaauuaccaaaacgccaagcaagaugaaucuuucuaugagcuuaugcuggaacaauacuugcguaaagagaauuucgccgaagagagcuacaaugcacguuauuuuaugcugaaguugaucuauaacaaucuuuuccugccgggcuuuacgaccgaccguaaggcguucgccgacagugugggauuugugcaaaugcagaacaaaaagcaagcugagaaagucaacccucgcaagaaagaggcguaugcguucgaggcgguacguccgaugaccgcagcagacucuaucgcagauuacauggcauacguucaaagugaauuaaugcaggagcaaaacaaaaaggaggaaaaaguugccgaggaaacucgcaucaauuuugaaaaguucguccuucagguguucauuaaaggguucgauucguucuugcgcgccaaagaguuugacuucguccaaaugccacaaccucaauugacugcuacggcguccaaccaacaaaaagccgacaaguuaaaccaacuggaagccucuauuacugcugauugcaaacuuacgccccaauaugcgaaagcggacgaugcuacacauaucgcguucuacgucuuuugcaaauuacuggaugcggcacacuugucuaauuugcguaacgagcugauuaaguuucgcgaauccguuaacgaauucaaauuccaccauuugcuggaaaucauugagauuugccuuuuaucugcagauguugugccaacagacuaucgugaucuuuauaguagcgaagcugacugcuuagcacgucugcgcccguucauugaacagggcgcagacaucacaaacuggucagacuuauuuguacaaucugacaaacacagcccagucauccacgcaaacauugagcuuaguguuaaauauggcacaacuaaacuguuagagcagauuaucaauaaagauacucaauucaagaccacagaggcaaauuuuaccgccuggaauacugcgcagaagagcaucgaacagcuuauuaagcaacgcgaggaccaucacgagcaaugggucaaggcuaaaaacgccgacgacaaagaaaaacaagagcgcaaacgcgagaaguccaacuuugcgcaaaaguuuauugagaaacacggugacgauuaucuugauaucugcgauuauaucaacacuuauaacuggcuugacaauaaaaugcacuucgugcaccugaaccgucugcacggcuugacuaucgagcuuuuaggucgcauggccggguuugucgcccuguuugaucgcgauuuucaauuuuucgaugagcaacagaucgcugacgaguucaaguuacacggauuugugaacuuacacaguauugacaagaagcucaaugaagucccuacuaaaaagaucaaagagaucuacgacauucguaacaaaaucauucaaauuaacggaaacaagaucaaugaguccgugcgugccaacuuaauucaauuuaucucgucuaaacguaauuacuauaauaacgccuucuugcacguguccaaugaugagaucaaagaaaagcagauguaugauauccgcaaccauaucgcgcacuucaacuauuugacgaaggacgcggcugacuucucuuugauugacuugauuaacgagcuucgcgaauuguuacauuaugaucgcaaacuuaagaacgcuguuuccaaggccuuuaucgaccuguuugauaagcacggcaugauucugaagcuuaagcuuaacgcagaccacaaguuaaagguugagucccuggagccaaagaaaauuuaccaucugggaucaucugcgaaggacaagccggaguaucaauauugcaccaaccaagucaugauggcauacuguaacaugugccgcucccuuuuagagaugaaaaaauaa

SEQ ID NO: 11042 - RNA, 3858 nt, Artificial Sequence
  Cas13a variant__Rhodobacter capsulatus__ETD76934.1__Cas13a
augcagauuggaaaaguucaaggccgcacgauuuccgaguucggcgacccugcuggcggcuuaaaacguaaaauuucgacagacgguaagaaucgcaaagaguugccugcacaucuuagcucagauccgaaggcucugaucggucaguggaucagugggaucgauaaaaucuaucgcaagccagauucucguaagucggacggcaaggcuauucacagccccacuccgucgaagaugcaguuugaugcacgugacgacuuaggugaagccuucuggaaacuuguuagcgaagccggguuggcccaagauucggauuacgaccaauuuaaacgucgucuucauccauauggggacaaguuccaaccugcagacucgggagcuaaauugaaguucgaggcggacccaccagaaccgcaagcguuucacggccgcugguacggugcuaugagcaaacgcggaaaugacgcgaaagagcuggcagcugcauuauacgagcaucuucaugucgacgaaaagcgcaucgacggucagccaaaacgcaaccccaagacggauaaauuugcgcccggauuagucguggcucgcgcucuggguauugaguccucgguuuuaccgcgugggauggcgcgucuugcacguaauuggggcgaggaggaaauucaaacuuauuucgucgucgacgucgcagcuagcguaaaagaaguugcgaaggcggccguaucggccgcucaggcuuucgacccuccacgucaaguuucgggccguucgcuuucacccaagguagguuuugccuuagcugagcaucuggaacgcgucacugguagcaagcguuguagcuuugacccugcugcaggccccaguguauuggcgcugcaugaugagguaaagaaaacuuacaagcguuugugcgcgcgugguaagaaugcugcgcgugcguuucccgcugacaaaacggaauuguuagcauugaugcgccauacccaugaaaaccgcgugcguaaccagauggugcguaugggacgcgucagcgaguaccgugggcaacaagccggugaccuggcgcagucacauuauuggacgagcgcaggacaaacugaaauuaaggagucugaaaucuuuguccgucuuuggguaggugccuuugccuuagcugggcguuccaugaaagcauggauugaccccaugggaaagauuguaaacacagaaaagaaugaccgugauuugacugccgcugugaauauccgccaagugaucuccaauaaagaaaugguggcagaagcuauggcucgucgcgguauuuacuuuggcgagacuccggaauuggaucgcuugggggcggaaggcaaugaaggauuuguuuuugcguuauuacguuauuuacgugggugucguaaccagaccuuccaucugggcgcacgugcugguuuuuuaaaagaaauccgcaaggagcuugaaaagacacguugggggaaggcaaaagaggcggagcacguuguguuaacagauaagacgguagcugcaauccgugcgauuauugacaaugaugcgaaggcuuuaggagcacgccugcuggccgacuuauccggagcauuuguagcgcacuacgcaucuaaagagcauuuuucgaccuuguacucugagaucguuaaggcugucaaggacgcucccgaagucucgucaggauugccccgcuugaaacugcugcuuaagcgcgccgacggggugcgcggguauguucauggguugcgugacacucguaagcaugcuuucgccaccaaauugcccccaccaccggcgccacgugagcuugacgacccagcuaccaaagcacguuauauugcuuugcugcgccuguaugacgguccauuucgcgccuaugcgucaggcaucacagggacggcuuuggccggacccgcggcgcgugcuaaggaagcugccacugcccuugcacaaagugucaacguuaccaaagcauauucagauguuauggaggggcgcucuucacgccugcgcccgcccaacgacggugagacccugcgugaguacuuaagugcuuuaacgggcgagacugcgaccgaauuccguguccaaaucggauacgagucggauucugaaaacgcacgcaaacaagcggaauuuauugagaauuaucgccgugauauguuggcuuuuauguuugaggauuacauucgcgcuaaagguuuugauuggaucuuaaaaaucgaaccgggagccacagcaaugacccgugcaccagugcugccugaaccuauugacacacguggacaauacgaacauuggcaggcggcauuguaucugguuaugcauuuugugcccgcguccgacguaaguaaucuucuucaucaguuacguaaaugggaggcucuucaagguaaauaugaauuaguacaggauggcgacgcaaccgaccaagcggaugcacgucgugaggcuuuggauuuaguuaaacguuuccgcgacguuuugguacuuuuucuuaagacaggagaggcacgcuucgaaggccgcgcggcucccuuugauuugaagccuuuccgugcuuuguucgcgaaccccgcgacuuuugaccgccuguucauggccacaccuacaaccgcacguccggcggaagaugaccccgaaggugacggggcaagcgaacccgaacuucgcgucgcacgcacgcugcgcggacuucgccagaucgcgcgcuacaaccacauggcaguuuugucggaucuuuucgcgaaacauaaggugcgcgaugaagaaguggcccgcuuagccgaaauugaggaugagacgcaggaaaaaucccagauuguugcggcacaggaacugcguacggauuugcaugacaagguaaugaagugccauccaaagacgauuaguccugaagaacgucagaguuacgcggccgccaucaagaccaucgaggagcaucguuuucugguugggcguguguacuugggagaucauuuacguuugcaucgucugaugauggaugugaucggacguuugaucgacuaugcaggcgccuaugaacgugauaccggcacguuucuuauuaaugcuucaaagcaauugggugcuggagccgacugggcugucacgaucgcuggugcggcgaacacagacgcucguacacaaacgcguaaggaccuugcgcacuuuaauguguuggaccgugcagauggcacucccgauuuaaccgcguuggugaaccgcgcucgugagaugauggcuuacgaccguaaacgcaagaaugcuguaccucgcucaauuuuagauaugcuggcucgucugggauugacuuuaaaauggcaaaugaaagaucauuuguugcaagacgcuacuauuacccaggcggccaucaagcacuuagacaaggugcgcuugaccgucggaggcccugccgcaguaacugaagcccguuucagccaagacuacuugcagaugguagcugcuguauuuaauggaaguguacagaauccuaagccucgccgucgcgacgauggugacgccuggcacaagccacccaagccagccacggcgcaaagucaaccugaccaaaagccacccaacaaagcgccuuccgcugguucucgucuuccgccuccccaaguuggugagguguacgaagggguaguugugaaggucauugacacaggcucacuuggguuccuugccguggagggggucgcaggcaauaucggucuucacaucucacgucuucgucguauucgugaagacgcgauuauuguaggacgucguuaucgcuuucgcguagagauuuaugugccuccuaagucgaauacuagcaaguuaaacgcugcggaccugguucguaucgauuaa

SEQ ID NO: 11043 - RNA, 1578 nt, Artificial Sequence
  Cas13a variant__Corynebacterium ulcerans__WP_038617242.1__Cas13
augccaaaauauugucucacugcaagauucccgcugggggucuaucuggggcauaccggcgacgcuaaccgagacgcauauccggauccggcucgguugcacgcggcgcuuaugaaugcggcagcucaagguguucaugcagaagaagauccaaacgaacaccaacucaggcccagucaacaaucgcuacaagcacugcagugguuagaagcacauccccccaccgguuuagcgaugccugagcagcaauggcucuccccagauacaucacgaaugauguaccgaaacguaggcucagugaagaucgacaaaaccggcguaacgcgugcuaccgagaaucgugcugucuccgauggcguauccgucaauggagcuuauggguauaucugggacgagaugcccguggauauagcagaagccauuaccgcauugcuccccgaugucgcaugccuaggagaagcuucuucucucguaguacuugaacagcaagaaaucgaagccacgcuuacucuugauccucaagcgaccgcuuuuucaaccgaacgcguucaaguccgaauagcgcugccuggacgcacucagcaccucagagaaguguuccaugcacgguauggaaagaagccuccuuccaaaaaagcggacaaguucuuaaaggaugacccgauccaugauccuccgauccccaaagaucacuuagguacggcucgcuaucuacgugucaacgcugcggauaaggaaugcgugacacccuggacaaaagucauuuuguuggagguacacgguaaacagcuaggggcgaaagaacagguucgcgcagcuguugcccuccaucgagcacuuauugccagaauuagaacggaugucucgccaguuaucacugggcguuaugcagcuggggcacaaagaccagcaaauaauuuagccauccaauacauaccgcaucgucacuuagaagcgcuuggauugaaaaccucagcguucgcgcuucuugucccccaagaugcugauuccacuguguacgaacaacucaaccaagcacucaccggaccuuuuccacucagaagugguggaaaacucuugugccagcuuaaguacaacggucacguauucagaggcgaugcauuuuggccagcuccucaaccaggaacuauccguaugugggagccauuaaacgucuuuaucccagaaucgcgaccccacaauaagcaacaaggugugcuguggcgccuggcggaugcaggcuuacucucaguggccuucgucuggcgcgacaacuucccgaccaaggaaacuggcccugcacgcuaugucgaacuacgcgacgcggccuauaacgcagauguacggauuuuucaugaucaccccguaagcagaaauacccgucgcuuuguccacaggaccaacaggaguuuaaccauccaaccuuggcgaggucucgugcacuuggggagccuccagcaggauagagcgaucauugcacuggggcaaucacgccaucugggcggaggucuguuaaucccuguggauauucccagaagugaauucgaaacgaugacaagcgagaugacucaugccuag

SEQ ID NO: 11044 - RNA, 3675 nt, Artificial Sequence
  Cas13b variant__Bergeyella zoohelcum__WP_002664492.1__Cas13b
auggaaaacaaaacaucuuuggggaauaauauuuauuacaacccuuuuaaaccacaagauaaaucguauuuugcggguuauuucaaugcagcaauggaaaauacagauaguguauuuagagaauugggaaaaagauuaaaagguaaagaguacacuucggagaauuuuuuugaugcuaucuuuaaggaaaauauuucauuaguggaauacgaaagguaugugaaauugcuuucugauuauuucccuauggcucgucuuuuggauaaaaaagaaguuccuauaaaagaacgaaaagaaaauuuuaaaaagaauuuuaaaggcauuauaaaagccguaagagauuuaagaaacuuuuauacgcauaaggaacacggagagguagaaauuacagaugaaauauuuggcguauuggaugagaugcugaaaagcacgguuuuaacgguaaaaaagaaaaaaguaaaaaccgauaaaacaaaagaaauccugaaaaaaagcauagaaaaacaauuggauauuuuaugccaaaagaaauuagaauaucuaagagacacagcaagaaaaauagaggagaagcguagaaaucaaagagaaagaggagagaaagaauugguagcuccauucaaauacagugauaaaagggaugauuuaauagcagcgauuuauaaugaugcuuuugauguuuauaucgauaagaaaaaagauagccuaaaagaauccagcaaagcaaaguacaauaccaaaagugauccucagcaagaagaaggcgauuugaaaauuccaauuucgaaaaacggaguagucuuccugcuuucuuuguuucucaccaaacaagaaauacacgcauucaaaucuaaaauagcaggguuuaaggcuacgguuaucgaugaagcaacgguaucugaagcaacggugagccauggaaaaaacagcauuuguuuuauggcuacgcacgaaauuuucucgcauuuggcuuacaaaaaauugaaacgaaaagugagaacggcugaaaucaacuauggugaggcagaaaaugcugaacagcuuuccguuuaugccaaagaaacucuaaugaugcagaugcuugaugaauugagcaaaguacccgauguggucuaucagaauuugagcgaagauguacaaaaaacuuucaucgaagauuggaaugaauaccuaaaagagaacaauggcgauguagggacaauggaagaagagcagguaauucauccagugauucgcaagcguuacgaagauaaauucaauuauuuugccauucgauuuuuagaugaguuugcucaguucccuacgcuucguuuucaagugcauuuagggaauuaucuucacgauucucgcccuaaagaaaaucugauuucugaccgaagaauaaaagaaaaaaucaccguuuucggaaggcuuucggaauuggaacauaaaaaagcauuguuuauaaaaaauaccgaaaccaaugaagauagagaacacuauugggaaauuuuuccuaaccccaauuaugauuuuccuaaggaaaauauuuccguuaaugauaaagauuuuccuaucgcggguaguauuuuggacagagagaaacagccugucgcagggaaaauugguauaaaagugaaauugcuuaaccaacaauauguuucagaaguagauaaagccguaaaagcccaucagcucaagcaaagaaaagccagcaagccgucuauccagaacauuauagaagaaauagugccaaucaaugaaagcaauccaaaagaagcuauuguuuucggugggcaacccacggcuuaucugaguaugaaugacauucauuccauuuuguaugaguuuuucgauaaaugggagaaaaagaaagaaaaguuagaaaagaaaggugaaaaagaauuaagaaaggaaauuggaaaagaguuagaaaagaaaaucguaggaaaaauucaagcucaaauccagcaaaucauagauaaagauaccaaugccaagauauuaaaaccuuaucaagacggaaauucuacugcuauugauaaagagaaauugauaaaagauuugaagcaagagcaaaacauucuacaaaaauuaaaagaugaacaaacgguucgugaaaaagaauauaaugauuuuauugcuuaucaagauaaaaauagggagauaaauaaagucagagauagaaaucauaaacaauauuuaaaagauaaccuuaaacgaaaguacccugaagcuccugcacgaaaagaaguucuuuauuaucgagaaaaaggaaaaguagcgguuugguuggcgaaugacaucaaacgcuuuaugccuaccgauuucaaaaacgaauggaaaggggagcaacacagcuuguuacaaaaaucguuggcguauuaugagcaauguaaagaggaguugaaaaaucuuuugccugaaaaaguauuucagcauuuaccuuuuaaguugggaggauauuuucaacaaaaauauuuguaccaauuuuacacuuguuauuuagauaaacgguuggaauacaucaguggguuggugcaacaagccgaaaacuuuaaauccgaaaauaaagucuucaaaaagguagaaaaugaguguuuuaaauuuuugaaaaaacaaaauuauacucacaaagaauuagaugcucggguucagucuauauugggguauccuaucuuuuuagagcggggcuuuauggaugaaaaaccuacgauaaucaaaggaaaaacuuuuaaaggaaaugaagcucuuuuugccgauugguuuagguauuacaaggaauaucagaauuuucagacauuuuaugauacugaaaauuauccgcuuguagaauuggaaaaaaaacaagcagaccgaaaacgaaaaacuaaaaucuaccaacaaaagaaaaacgauguguuuacacuuuugauggcaaaacauauuuucaaaucgguauucaagcaggauagcaucgaucaguuuucguuagaagauuuguaucaaucucgggaggaacgcuuaggaaaucaggagagagccagacaaacgggcgagcgaaauacuaacuauauuuggaacaaaaccguugauuuaaaguugugugacggaaaaauuacgguagaaaauguaaagcuaaaaaauguaggagauuucauaaaauaugaauacgaccaaaggguucaagcuuucuuaaaauaugaggaaaauauagaauggcaggcguuucuaaucaaagagaguaaggaagaggaaaauuauccguaugugguggaaagagaaauagagcaauaugaaaaagugagaagggaagaacuguugaaggaaguccaccuuauagaggaauauauuuuggaaaagguaaaagauaaggaaauauuaaaaaaaggggauaaucaaaauuucaaauacuacauucucaacggacuuuuaaagcaacuuaaaaaugaagauguggagagcuauaagguauucaacuuaaauacugaaccugaagaugugaacauuaaccaacuaaaacaagaagcaaccgauuuagaacaaaaagcuuuuguuuuaaccuauauucguaauaaauuugcacacaaccaauuaccuaaaaaagaauuuugggacuauugucaagaaaaauacggcaaaauagaaaaagaaaaaaccuaugccgaguauuuugcugagguauuuaaaaaggaaaaagaagcacugauaaaguaa

SEQ ID NO: 11045 - RNA, 3675 nt, Artificial Sequence
  Cas13b variant__Bergeyella zoohelcum__WP_002664492.1 modified__Cas13b(R116A,H121A,R1177A,H1182A)
auggaaaacaaaacaucuuuggggaauaauauuuauuacaacccuuuuaaaccacaagauaaaucguauuuugcggguuauuucaaugcagcaauggaaaauacagauaguguauuuagagaauugggaaaaagauuaaaagguaaagaguacacuucggagaauuuuuuugaugcuaucuuuaaggaaaauauuucauuaguggaauacgaaagguaugugaaauugcuuucugauuauuucccuauggcucgucuuuuggauaaaaaagaaguuccuauaaaagaacgaaaagaaaauuuuaaaaagaauuuuaaaggcauuauaaaagccguaagagauuuagcaaacuuuuauacggcaaaggaacacggagagguagaaauuacagaugaaauauuuggcguauuggaugagaugcugaaaagcacgguuuuaacgguaaaaaagaaaaaaguaaaaaccgauaaaacaaaagaaauccugaaaaaaagcauagaaaaacaauuggauauuuuaugccaaaagaaauuagaauaucuaagagacacagcaagaaaaauagaggagaagcguagaaaucaaagagaaagaggagagaaagaauugguagcuccauucaaauacagugauaaaagggaugauuuaauagcagcgauuuauaaugaugcuuuugauguuuauaucgauaagaaaaaagauagccuaaaagaauccagcaaagcaaaguacaauaccaaaagugauccucagcaagaagaaggcgauuugaaaauuccaauuucgaaaaacggaguagucuuccugcuuucuuuguuucucaccaaacaagaaauacacgcauucaaaucuaaaauagcaggguuuaaggcuacgguuaucgaugaagcaacgguaucugaagcaacggugagccauggaaaaaacagcauuuguuuuauggcuacgcacgaaauuuucucgcauuuggcuuacaaaaaauugaaacgaaaagugagaacggcugaaaucaacuauggugaggcagaaaaugcugaacagcuuuccguuuaugccaaagaaacucuaaugaugcagaugcuugaugaauugagcaaaguacccgauguggucuaucagaauuugagcgaagauguacaaaaaacuuucaucgaagauuggaaugaauaccuaaaagagaacaauggcgauguagggacaauggaagaagagcagguaauucauccagugauucgcaagcguuacgaagauaaauucaauuauuuugccauucgauuuuuagaugaguuugcucaguucccuacgcuucguuuucaagugcauuuagggaauuaucuucacgauucucgcccuaaagaaaaucugauuucugaccgaagaauaaaagaaaaaaucaccguuuucggaaggcuuucggaauuggaacauaaaaaagcauuguuuauaaaaaauaccgaaaccaaugaagauagagaacacuauugggaaauuuuuccuaaccccaauuaugauuuuccuaaggaaaauauuuccguuaaugauaaagauuuuccuaucgcggguaguauuuuggacagagagaaacagccugucgcagggaaaauugguauaaaagugaaauugcuuaaccaacaauauguuucagaaguagauaaagccguaaaagcccaucagcucaagcaaagaaaagccagcaagccgucuauccagaacauuauagaagaaauagugccaaucaaugaaagcaauccaaaagaagcuauuguuuucggugggcaacccacggcuuaucugaguaugaaugacauucauuccauuuuguaugaguuuuucgauaaaugggagaaaaagaaagaaaaguuagaaaagaaaggugaaaaagaauuaagaaaggaaauuggaaaagaguuagaaaagaaaaucguaggaaaaauucaagcucaaauccagcaaaucauagauaaagauaccaaugccaagauauuaaaaccuuaucaagacggaaauucuacugcuauugauaaagagaaauugauaaaagauuugaagcaagagcaaaacauucuacaaaaauuaaaagaugaacaaacgguucgugaaaaagaauauaaugauuuuauugcuuaucaagauaaaaauagggagauaaauaaagucagagauagaaaucauaaacaauauuuaaaagauaaccuuaaacgaaaguacccugaagcuccugcacgaaaagaaguucuuuauuaucgagaaaaaggaaaaguagcgguuugguuggcgaaugacaucaaacgcuuuaugccuaccgauuucaaaaacgaauggaaaggggagcaacacagcuuguuacaaaaaucguuggcguauuaugagcaauguaaagaggaguugaaaaaucuuuugccugaaaaaguauuucagcauuuaccuuuuaaguugggaggauauuuucaacaaaaauauuuguaccaauuuuacacuuguuauuuagauaaacgguuggaauacaucaguggguuggugcaacaagccgaaaacuuuaaauccgaaaauaaagucuucaaaaagguagaaaaugaguguuuuaaauuuuugaaaaaacaaaauuauacucacaaagaauuagaugcucggguucagucuauauugggguauccuaucuuuuuagagcggggcuuuauggaugaaaaaccuacgauaaucaaaggaaaaacuuuuaaaggaaaugaagcucuuuuugccgauugguuuagguauuacaaggaauaucagaauuuucagacauuuuaugauacugaaaauuauccgcuuguagaauuggaaaaaaaacaagcagaccgaaaacgaaaaacuaaaaucuaccaacaaaagaaaaacgauguguuuacacuuuugauggcaaaacauauuuucaaaucgguauucaagcaggauagcaucgaucaguuuucguuagaagauuuguaucaaucucgggaggaacgcuuaggaaaucaggagagagccagacaaacgggcgagcgaaauacuaacuauauuuggaacaaaaccguugauuuaaaguugugugacggaaaaauuacgguagaaaauguaaagcuaaaaaauguaggagauuucauaaaauaugaauacgaccaaaggguucaagcuuucuuaaaauaugaggaaaauauagaauggcaggcguuucuaaucaaagagaguaaggaagaggaaaauuauccguaugugguggaaagagaaauagagcaauaugaaaaagugagaagggaagaacuguugaaggaaguccaccuuauagaggaauauauuuuggaaaagguaaaagauaaggaaauauuaaaaaaaggggauaaucaaaauuucaaauacuacauucucaacggacuuuuaaagcaacuuaaaaaugaagauguggagagcuauaagguauucaacuuaaauacugaaccugaagaugugaacauuaaccaacuaaaacaagaagcaaccgauuuagaacaaaaagcuuuuguuuuaaccuauauugcaaauaaauuugcagcaaaccaauuaccuaaaaaagaauuuugggacuauugucaagaaaaauacggcaaaauagaaaaagaaaaaaccuaugccgaguauuuugcugagguauuuaaaaaggaaaaagaagcacugauaaaguaa

SEQ ID NO: 11046 - RNA, 3384 nt, Artificial Sequence
  Cas13b variant__Prevotella buccae__WP_004343973.1__Cas13b
augcaaaaacaagauaaauuauuuguagauagaaagaaaaaugcuauauuugccuuuccuaaauauauaacaauaauggaaaacaaagagaaaccugaaccaauuuauuaugaauugacagauaagcauuucugggcugccuuucuuaacuuggcgcgccacaaugucuauaccaccauuaaucacaucaacagacguuuggaaauagcagagcuaaaagacgauggauauaugaugggcauuaaaggcagcuggaacgagcaagcgaaaaaacucgacaaaaaaguucggcugagagacuugaucaugaaacacuuuccuuuucuggaagcugcagcuuaugaaaugacaaacucuaaaagucccaacaauaaggagcaacgggaaaaggaacaauccgaagcccuaucacuuaacaacuugaagaauguucuauucauuuucuuggaaaaacuucagguucucaggaacuacuacucccauuacaaguauucugaagaauccccaaaaccgauauuugaaacaagccuuuugaaaaacauguauaagguuuucgaugccaaugugcgguuaguaaagagagacuauaugcaucaugagaauauagacaugcaaagagauuuuacacaucucaacaggaaaaaacaagugggacgaacaaaaaacaucauagacaguccuaacuuucauuaccauuuugcagauaaagaaggcaauaugaccauagcaggcuuacuguucuucgucucuuuauuucuugauaaaaaagacgcuauuuggaugcagaaaaagcuaaagggauuuaaagauggcagaaacuugcgugagcaaaugacaaacgaaguauuuugcagaagccguauaucuuugccuaagcuaaaauuagagaauguacagacaaaagacuggaugcaacuugauaugcuuaacgaauugguucgcugucccaaaucgcuguaugaacgguuacgagaaaaagauagggaaaguuuuaaaguaccuuucgauauuuucucugacgacuauaaugcugaagaagaaccauuuaagaacacgcuuguaaggcaucaagaccgcuuuccauauuuugucuugagauauuucgauuuaaaugagauauucgaacaacuccgcuuccaaauagauuuagguaccuaucauuucucuaucuauaacaaacguaucggugacgaagaugaaguucgccaucucacacaucaucuauauggcuuugcgcgcauucaggacuuugcaccacaaaaccaaccagaagaauggagaaaauuagugaaagacuuagaucauuuugagacaucgcaagagccuuacauaucuaagacugcuccacauuaccauuuagagaaugaaaagauaggcauuaaguuuugcagugcccacaacaaccucuuuccaucucuucagaccgacaaaacaugcaauggaagaaguaaauuuaaucucggaacacaauuuacagcagaagcauuuuuaaguguccacgaauuguugccgaugauguuuuauuaucuguuauugaccaaggauuacuccagaaaagaaagcgcagacaaaguagagggaauuauaagaaaagaaauaagcaacauauacgcuaucuacgaugcuuuugccaauaaugagauaaauagcauugcagacuuaacccgucggcuucaaaauacaaauauacuacaaggccauuugccaaaacaaaugauuuccauauugaaaggcagacaaaaagauaugggaaaagaggcugagcgcaaaauuggggaaaugauagacgacacccaaagaagacuugacuugcucugcaagcagacaaaucagaagauaaggauuggcaaaaggaaugccggucugcuaaaaucgggaaaaauugcagauugguugguaaaugacaugaugcgcuuccaaccuguucaaaaagaccaaaauaacauuccaauaaacaauagcaaggcuaacagcaccgaauaucgaaugcuucagcgugcgcuugcccuuuucggcagugagaacuuccgccuuaaggcauauuuuaaucaaaugaaucuuguggggaaugacaauccgcauccuuuccuugcagaaacacaaugggaacaucaaacuaacauucugucuuucuaccgaaacuauuuggaagcgaggaaaaaguaucuuaagggcuuaaaaccacaaaacuggaaacaauaucagcauuuucucauacuuaaaguacagaagaccaaccgcaacacauuaguuacaggauggaaaaacaguuucaaucucccccguggaauauuuacccaaccaauaagggaaugguuugagaaacauaauaauucaaaaagaauauacgaccaaauacuaucuuuugaccgaguaggguuuguugcaaaagcuauucccuuauacuuugcagaagaauauaaagacaauguacagccuuucuacgauuauccguucaauaucggcaacagacuuaaaccaaaaaaaaggcaauucuuagauaaaaaagagcgugucgaauuguggcaaaagaauaaagagcuauucaaaaauuauccgucugaaaagaaaaagacagacuuagcuuaucuugauuuuuuaucauggaaaaaguucgaacgcgaacugcgacuuaucaagaaucaggauaucgucacaugguugauguucaaagaacuauucaauauggcuacuguggaaggauugaagauuggagaaauacaucugagggacaucgauacaaacacggcaaaugaggaaagcaacaauauucuaaauagaaucaugcccaugaaguugccuguuaaaacauacgaaacagacaauaaaggaaauauauuaaaggaaagaccuuuagcaaccuuuuauaucgaagaaacggaaaccaaaguccugaaacagggcaauuucaaagcauugguaaaagaccgaagacucaaugggcuauucucauuugcagaaacuacagacuugaacuuagaggaacauccuaucagcaaauugaguguagaccuugagcuuauaaaauaucagacuacaaggauuaguaucuuugagaugacauuaggacuggaaaagaaacucauagacaaauauuccacacuaccuacagauagcuucagaaauaugcuugaaaggugguugcagugcaaagcuaauagaccggaauuaaagaauuacguuaauaguuugauugcagugagaaaugcuuuuucccacaaccaguaucccauguaugaugccacacucuuugcugaaguuaaaaaauuuacucuuuucccuucugucgauacaaaaaagauugagcuaaauauagcgccacaguuacuggaaauaguaggaaaagccauaaaagaaauugaaaaaucagaaaauaaaaacuaa

SEQ ID NO: 11047 - RNA, 3273 nt, Artificial Sequence
  Cas13b variant__Prevotella sp.__WP_044065294__Cas13b
augaauauaccugcauuaguggaaaaccagaagaaguauuucgguacauacucugucauggcaaugcugaacgcacagaccguacucgaccacauacagaaaguggcagacauagagggggaacagaacgagaacaacgaaaaucuaugguuccaccccguaaugagccauuuauacaaugcgaagaauggauaugacaaacagccggaaaagacuauguucaucaucgaacgucugcagucauauuuuccuuuccucaagauuauggcugaaaaccaaagagaguauucgaacggaaaauacaaacagaauaggguugaggugaacagcaacgacaucuuugaaguucugaaaagggcuuucggcgugcugaaaauguaucgcgaccuaaccaaccauuacaaaaccuacgaagaaaagcugaacgacggcugcgaguuucugacgaguacugagcagccucuuuccggaaugauaaacaacuacuacacuguagcccugcgaaacaugaaugagcguuauggauacaaaaccgaagaccucgccuuuauacaggacaaaagauucaaauucgucaaagacgcauacggaaaaaagaaaucacaaguaaauaccgguuucuuccucagucugcaagacuacaacggcgacacacaaaagaaacuccacuugucuggagucggcauagccuugcuuaucugucuguuccucgacaagcaguauaucaacaucuuccugucaaggcuuccuaucuucucuuccuauaaugcacaaucggaagagcgacgcaucaucauccguucuuuuggcauaaacagcaucaaacugcccaaagaccgcauccacucugaaaagagcaacaagucgguggcuauggauaugcugaaugaggugaagcguuguccggacgaacuguucacuacccucucggcugaaaagcagucucgauucagaauuauuuccgacgaccacaacgaggugcuuaugaaacguaguuccgacagauucgugccauugcuauugcaauauauugacuacggcaagcuguucgaccacauccguuuucaugugaauauggggaaacugcgcuaucugcucaaagccgacaagaccugcaucgacggucagacacgagugagggugauagaacagccucucaacgguuucggaagauuggaagaggcugaaacgaugcgaaagcaagaaaacggaacuuucggcaauagcggcauucgcauucgcgauuuugagaacaugaaaagagacgacgccaauccggcaaacuauccauauaucguggacacauauacucacuauauauuggagaacaacaagguggaaauguucauaaacgauaaagaagacucagccccauuguugccugugauugaggaugacagauaugugguaaagaccauuccauccugccguaugagcacucuugaaauaccugccauggcauuucauauguuccuguucgguagcaaaaagaccgaaaagcuuauugucgauguucacaacagguauaagagauuguuccaagcgaugcaaaaagaagagguaacagcugaaaacauagccucuuucggcauugcugaaagcgaucugccccagaagauucuugaucucaucagcggaaaugcucauggcaaggauguugacgccuucaucaggcuuaccgucgacgacaugcuuaccgauaccgaacggcgcaucaagagauuuaaagacgaccgcaaauccauacguucugccgacaacaagaugggcaagcgcgguuucaaacagauuucuacagguaagcuggcggauuuccucgccaaagacaucguuuuguuccaaccuucuguaaaugauggcgagaacaagauuacgggauugaacuaccgcaucaugcagucugccaucgccguuuacgacaguggcgacgauuaugaagccaagcaacaguucaagcugauguuugagaaagcccggcucaucggcaaaggcacaacagagccucauccuuucuuauauaaggucuuugcgagaucuaucccugccaaugccguggaguucuaugagagguaucuuauagagcgcaaauucuaucucaccggacucuccaacgagauaaagaagggaaacaggguggaugugccuuucaucagacgugaccagaacaaauggaaaacaccagcgaugaagacucucggcagaaucuacucugaagaccugccgguggaguugccucgacagauguuugacaacgaaaucaagagccaccugaaaucgcugccacagauggagggcauugauuucaacaaugccaacgucacguaucucauugcggaauauaugaaacggguauuggaugaugauuuccagacauucuaccaauggaaccgcaacuaucgcuauauggacaugcugaagggugaauacgacaggaaagguucgcugcagcacugcuucacauccguagaagaaagagaagguuuauggaaagaacgugcaagccggacugaacgcuacaggaaacaggcuucaaacaaaaucaggucuaacagacagaugcguaaugccucuucugaagaaaucgaaacgauauuagacaagcguuugaguaacagccgcaacgaauaccagaaaagugagaaggugauccgcagauacagaguacaggaugcccugcucuucuuauuggcaaagaagacucugacggaacuggcggauuucgacggcgagagauucaagcugaaagagauuaugccugaugcagaaaagggaauccugucugagauuaugccuaugucauucacuuuugaaaagggcggcaagaaauauaccauaacaucggaaggcaugaagcugaagaacuauggugauuucuucgucuuggcaagcgacaagagaaucggcaacuuguuagaacuuguuggcuccgacauuguauccaaggaggacaucauggaagaauucaauaaguaugaccaaugccgaccugaaauaucgagcaucguauucaacuuagagaaaugggcauucgacacuuauccugaguugucagcgagaguugacagagaagaaaagguugauuucaaguccaucuuaaagauucuccuaaacaacaagaauaucaauaaagaacaaagugacauauugcgaaaaaucaggaaugcuuucgaccacaacaacuaucccgacaaagguguuguugagauaaaggcuuugccugaaauugccaugagcauaaagaaagcauucggagaauaugccaucaugaaauag

SEQ ID NO: 11048 - RNA, 4152 nt, Artificial Sequence
  Cas13b variant__Artificial____PspCas13b-GS-HsADAR2DD(E488Q,del984-1090)
augaacauccccgcucugguggaaaaccagaagaaguacuuuggcaccuacagcgugauggccaugcugaacgcucagaccgugcuggaccacauccagaagguggccgauauugagggcgagcagaacgagaacaacgagaaucugugguuucaccccgugaugagccaccuguacaacgccaagaacggcuacgacaagcagcccgagaaaaccauguucaucaucgagcggcugcagagcuacuucccauuccugaagaucauggccgagaaccagagagaguacagcaacggcaaguacaagcagaaccgcguggaagugaacagcaacgacaucuucgaggugcugaagcgcgccuucggcgugcugaagauguacagggaccugaccaacgcauacaagaccuacgaggaaaagcugaacgacggcugcgaguuccugaccagcacagagcaaccucugagcggcaugaucaacaacuacuacacaguggcccugcggaacaugaacgagagauacggcuacaagacagaggaccuggccuucauccaggacaagcgguucaaguucgugaaggacgccuacggcaagaaaaagucccaagugaauaccggauucuuccugagccugcaggacuacaacggcgacacacagaagaagcugcaccugagcggagugggaaucgcccugcugaucugccuguuccuggacaagcaguacaucaacaucuuucugagcaggcugcccaucuucuccagcuacaaugcccagagcgaggaacggcggaucaucaucagauccuucggcaucaacagcaucaagcugcccaaggaccggauccacagcgagaaguccaacaagagcguggccauggauaugcucaacgaagugaagcggugccccgacgagcuguucacaacacugucugccgagaagcagucccgguucagaaucaucagcgacgaccacaaugaagugcugaugaagcggagcagcgacagauucgugccucugcugcugcaguauaucgauuacggcaagcuguucgaccacaucagguuccacgugaacaugggcaagcugagauaccugcugaaggccgacaagaccugcaucgacggccagaccagagucagagugaucgagcagccccugaacggcuucggcagacuggaagaggccgagacaaugcggaagcaagagaacggcaccuucggcaacagcggcauccggaucagagacuucgagaacaugaagcgggacgacgccaauccugccaacuaucccuacaucguggacaccuacacacacuacauccuggaaaacaacaaggucgagauguuuaucaacgacaaagaggacagcgccccacugcugcccgugaucgaggaugauagauacguggucaagacaauccccagcugccggaugagcacccuggaaauuccagccauggccuuccacauguuucuguucggcagcaagaaaaccgagaagcugaucguggacgugcacaaccgguacaagagacuguuccaggccaugcagaaagaagaagugaccgccgagaauaucgccagcuucggaaucgccgagagcgaccugccucagaagauccuggaucugaucagcggcaaugcccacggcaaggauguggacgccuucaucagacugaccguggacgacaugcugaccgacaccgagcggagaaucaagagauucaaggacgaccggaaguccauucggagcgccgacaacaagaugggaaagagaggcuucaagcagaucuccacaggcaagcuggccgacuuccuggccaaggacaucgugcuguuucagcccagcgugaacgauggcgagaacaagaucaccggccugaacuaccggaucaugcagagcgccauugccguguacgauagcggcgacgauuacgaggccaagcagcaguucaagcugauguucgagaaggcccggcugaucggcaagggcacaacagagccucauccauuucuguacaagguguucgcccgcagcauccccgccaaugccgucgaguucuacgagcgcuaccugaucgagcggaaguucuaccugaccggccuguccaacgagaucaagaaaggcaacagaguggaugugcccuucauccggcgggaccagaacaaguggaaaacacccgccaugaagacccugggcagaaucuacagcgaggaucugcccguggaacugcccagacagauguucgacaaugagaucaagucccaccugaagucccugccacagauggaaggcaucgacuucaacaaugccaacgugaccuaucugaucgccgaguacaugaagagagugcuggacgacgacuuccagaccuucuaccaguggaaccgcaacuaccgguacauggacaugcuuaagggcgaguacgacagaaagggcucccugcagcacugcuucaccagcguggaagagagagaaggccucuggaaagagcgggccuccagaacagagcgguacagaaagcaggccagcaacaagauccgcagcaaccggcagaugagaaacgccagcagcgaagagaucgagacaauccuggauaagcggcugagcaacagccggaacgaguaccagaaaagcgagaaagugauccggcgcuacagagugcaggaugcccugcuguuucugcuggccaaaaagacccugaccgaacuggccgauuucgacggcgagagguucaaacugaaagaaaucaugcccgacgccgagaagggaauccugagcgagaucaugcccaugagcuucaccuucgagaaaggcggcaagaaguacaccaucaccagcgagggcaugaagcugaagaacuacggcgacuucuuugugcuggcuagcgacaagaggaucggcaaccugcuggaacucgugggcagcgacaucguguccaaagaggauggaucccuucaacugccuccacuugaaagacugacacugggaucccagcugcauuuaccgcagguuuuagcugacgcugucucacgccugguccuggguaaguuuggugaccugaccgacaacuucuccuccccucacgcucgcagaaaagugcuggcuggagucgucaugacaacaggcacagauguuaaagaugccaaggugauaaguguuucuacaggaacaaaauguauuaauggugaauacaugagugaucguggccuugcauuaaaugacugccaugcagaaauaauaucucggagauccuugcucagauuucuuuauacacaacuugagcuuuacuuaaauaacaaagaugaucaaaaaagauccaucuuucagaaaucagagcgagggggguuuaggcugaaggagaauguccaguuucaucuguacaucagcaccucucccuguggagaugccagaaucuucucaccacaugagccaauccuggaagaaccagcagauagacacccaaaucguaaagcaagaggacagcuacggaccaaaauagagucuggucaggggacgauuccagugcgcuccaaugcgagcauccaaacgugggacggggugcugcaaggggagcggcugcucaccauguccugcagugacaagauugcacgcuggaacguggugggcauccagggaucacugcucagcauuuucguggagcccauuuacuucucgagcaucauccugggcagccuuuaccacggggaccaccuuuccagggccauguaccagcggaucuccaacauagaggaccugccaccucucuacacccucaacaagccuuugcucaguggcaucagcaaugcagaagcacggcagccagggaaggcccccaacuucagugucaacuggacgguaggcgacuccgcuauugaggucaucaacgccacgacugggaaggaugagcugggccgcgcgucccgccuguguaagcacgcguuguacugucgcuggaugcgugugcacggcaagguucccucccacuuacuacgcuccaagauuaccaagcccaacguguaccaugaguccaagcuggcggcaaaggaguaccaggccgccaaggcgcgucuguucacagccuucaucaaggcggggcugggggccuggguggagaagcccaccgagcaggaccaguucucacucacguaa

SEQ ID NO: 11049 - RNA, 4152 nt, Artificial Sequence
  Cas13b variant__Artificial____PspCas13b-GS-HsADAR2DD(E488Q,T375G,del984- 1090)
augaacauccccgcucugguggaaaaccagaagaaguacuuuggcaccuacagcgugauggccaugcugaacgcucagaccgugcuggaccacauccagaagguggccgauauugagggcgagcagaacgagaacaacgagaaucugugguuucaccccgugaugagccaccuguacaacgccaagaacggcuacgacaagcagcccgagaaaaccauguucaucaucgagcggcugcagagcuacuucccauuccugaagaucauggccgagaaccagagagaguacagcaacggcaaguacaagcagaaccgcguggaagugaacagcaacgacaucuucgaggugcugaagcgcgccuucggcgugcugaagauguacagggaccugaccaacgcauacaagaccuacgaggaaaagcugaacgacggcugcgaguuccugaccagcacagagcaaccucugagcggcaugaucaacaacuacuacacaguggcccugcggaacaugaacgagagauacggcuacaagacagaggaccuggccuucauccaggacaagcgguucaaguucgugaaggacgccuacggcaagaaaaagucccaagugaauaccggauucuuccugagccugcaggacuacaacggcgacacacagaagaagcugcaccugagcggagugggaaucgcccugcugaucugccuguuccuggacaagcaguacaucaacaucuuucugagcaggcugcccaucuucuccagcuacaaugcccagagcgaggaacggcggaucaucaucagauccuucggcaucaacagcaucaagcugcccaaggaccggauccacagcgagaaguccaacaagagcguggccauggauaugcucaacgaagugaagcggugccccgacgagcuguucacaacacugucugccgagaagcagucccgguucagaaucaucagcgacgaccacaaugaagugcugaugaagcggagcagcgacagauucgugccucugcugcugcaguauaucgauuacggcaagcuguucgaccacaucagguuccacgugaacaugggcaagcugagauaccugcugaaggccgacaagaccugcaucgacggccagaccagagucagagugaucgagcagccccugaacggcuucggcagacuggaagaggccgagacaaugcggaagcaagagaacggcaccuucggcaacagcggcauccggaucagagacuucgagaacaugaagcgggacgacgccaauccugccaacuaucccuacaucguggacaccuacacacacuacauccuggaaaacaacaaggucgagauguuuaucaacgacaaagaggacagcgccccacugcugcccgugaucgaggaugauagauacguggucaagacaauccccagcugccggaugagcacccuggaaauuccagccauggccuuccacauguuucuguucggcagcaagaaaaccgagaagcugaucguggacgugcacaaccgguacaagagacuguuccaggccaugcagaaagaagaagugaccgccgagaauaucgccagcuucggaaucgccgagagcgaccugccucagaagauccuggaucugaucagcggcaaugcccacggcaaggauguggacgccuucaucagacugaccguggacgacaugcugaccgacaccgagcggagaaucaagagauucaaggacgaccggaaguccauucggagcgccgacaacaagaugggaaagagaggcuucaagcagaucuccacaggcaagcuggccgacuuccuggccaaggacaucgugcuguuucagcccagcgugaacgauggcgagaacaagaucaccggccugaacuaccggaucaugcagagcgccauugccguguacgauagcggcgacgauuacgaggccaagcagcaguucaagcugauguucgagaaggcccggcugaucggcaagggcacaacagagccucauccauuucuguacaagguguucgcccgcagcauccccgccaaugccgucgaguucuacgagcgcuaccugaucgagcggaaguucuaccugaccggccuguccaacgagaucaagaaaggcaacagaguggaugugcccuucauccggcgggaccagaacaaguggaaaacacccgccaugaagacccugggcagaaucuacagcgaggaucugcccguggaacugcccagacagauguucgacaaugagaucaagucccaccugaagucccugccacagauggaaggcaucgacuucaacaaugccaacgugaccuaucugaucgccgaguacaugaagagagugcuggacgacgacuuccagaccuucuaccaguggaaccgcaacuaccgguacauggacaugcuuaagggcgaguacgacagaaagggcucccugcagcacugcuucaccagcguggaagagagagaaggccucuggaaagagcgggccuccagaacagagcgguacagaaagcaggccagcaacaagauccgcagcaaccggcagaugagaaacgccagcagcgaagagaucgagacaauccuggauaagcggcugagcaacagccggaacgaguaccagaaaagcgagaaagugauccggcgcuacagagugcaggaugcccugcuguuucugcuggccaaaaagacccugaccgaacuggccgauuucgacggcgagagguucaaacugaaagaaaucaugcccgacgccgagaagggaauccugagcgagaucaugcccaugagcuucaccuucgagaaaggcggcaagaaguacaccaucaccagcgagggcaugaagcugaagaacuacggcgacuucuuugugcuggcuagcgacaagaggaucggcaaccugcuggaacucgugggcagcgacaucguguccaaagaggauggaucccuucaacugccuccacuugaaagacugacacugggaucccagcugcauuuaccgcagguuuuagcugacgcugucucacgccugguccuggguaaguuuggugaccugaccgacaacuucuccuccccucacgcucgcagaaaagugcuggcuggagucgucaugacaacaggcacagauguuaaagaugccaaggugauaaguguuucuacaggaggcaaauguauuaauggugaauacaugagugaucguggccuugcauuaaaugacugccaugcagaaauaauaucucggagauccuugcucagauuucuuuauacacaacuugagcuuuacuuaaauaacaaagaugaucaaaaaagauccaucuuucagaaaucagagcgagggggguuuaggcugaaggagaauguccaguuucaucuguacaucagcaccucucccuguggagaugccagaaucuucucaccacaugagccaauccuggaagaaccagcagauagacacccaaaucguaaagcaagaggacagcuacggaccaaaauagagucuggucaggggacgauuccagugcgcuccaaugcgagcauccaaacgugggacggggugcugcaaggggagcggcugcucaccauguccugcagugacaagauugcacgcuggaacguggugggcauccagggaucacugcucagcauuuucguggagcccauuuacuucucgagcaucauccugggcagccuuuaccacggggaccaccuuuccagggccauguaccagcggaucuccaacauagaggaccugccaccucucuacacccucaacaagccuuugcucaguggcaucagcaaugcagaagcacggcagccagggaaggcccccaacuucagugucaacuggacgguaggcgacuccgcuauugaggucaucaacgccacgacugggaaggaugagcugggccgcgcgucccgccuguguaagcacgcguuguacugucgcuggaugcgugugcacggcaagguucccucccacuuacuacgcuccaagauuaccaagcccaacguguaccaugaguccaagcuggcggcaaaggaguaccaggccgccaaggcgcgucuguucacagccuucaucaaggcggggcugggggccuggguggagaagcccaccgagcaggaccaguucucacucacguaa

SEQ ID NO: 11050 - RNA, 2862 nt, Artificial Sequence
  Cas13b variant__Alistipes sp.__WP_047447901.1__Cas13b
augaguaacgaaauuggggcguuucgggagcaucaguuugccuacgcaccuggaaacgagaagcaggaggaggcaaccuuugcuaccuacuuuaaucuggcucuuucuaacguagaggggaugauguuuggugaaguugaaucgaaucccgauaagauugaaaagagccuagauacauugccgcccgcaauauuaaggcaaauugccucauucauuugguugagcaaggaagaucaccccgauaaggcauacagcacggaagagguaaagguuauugugacggaucuuguucguaggcuaugcuucuauaggaauuacuucucgcauugcuucuauuuggacacgcaauacuuuuacagcgacgagcuuguugacaccacagcuauaggggagaaacuucccuauaacuuucaucacuuuauuaccaaucggcuuuuuagauauucucugccagaaaucacccuuuuuagguggaacgagggagaaaggaaguacgaaauacuucgcgaugggcugauuuucuucugcugccucuuuuuaaaaaggggacaggccgagcgcuuucuuaacgagcuucgauuuuuuaaacgaacugaugaggaagggcggauaaagcgaaccauuuuuaccaaauacugcacccgugagucucacaagcacauuggaauagaggagcaggacuuuuuaaucuuccaagauauuauuggcgaccuaaaccgggugcccaaagugugcgaugggguugucgauuugagcaaagagaacgagagguacaucaaaaauagggagacauccaacgaaagugaugagaauaaggcucgauauaggcugcuuauucgcgaaaaggauaaguuuccuuacuaucugaugcguuacaucgucgauuuuggggugcugcccugcauuaccuuuaagcaaaacgacuacucuacaaaggagggacgaggacaauuccacuaucaggaugcugccguugcccaagaggagcgaugcuacaacuuugugguucggaauggcaacguuuacuauucguauaugccacaagcacaaaauguggugcguauuagcgagcugcagggaaccauuagcguggaggaguugcgcaauaugguguaugcuucgauuaaugguaaggauguaaauaaaagcguagagcaauaccucuaccaucuucaucugcuuuacgaaaaaauacugacaauaagcgggcagacuauaaaggaagggcggguugauguagaggauuaccgaccgcugcucgauaagcugcugcuaaggccagcuucgaauggcgaggagcuaaggcgcgagcuccgaaagcugcuccccaaacggguaugcgacuugcuuagcaaccgcuuugacugcucggaagguguuuccgcuguagagaaacgcuuaaaggcaaucuuacuacggcacgagcagcugcugcucucgcagaacccagcucugcauaucgauaagauaaaaucgguuauagauuaccuguaccucuuuuucagcgacgacgaaaaguuucgucagcagccuaccgaaaaggcucauagagggcuaaaggacgaggaguuucagauguaccacuaccuuguuggcgacuacgacagccauccuuuggcgcuguggaaggagcuggaggcaagugggcggcuuaagcccgaaaugagaaagcuaaccucugccaccucgcugcaugggcuuuacaugcuuugccuaaagggaacgguggaguggugccgcaagcagcuaaugagcauaggaaaaggaacggccaagguggaggcuauugccgauagggugggguuaaagcucuacgauaagcuaaaggaguauacccccgagcagcucgaaagggagguuaagcuugugguuaugcacgguuaugccgcugccgcuaccccaaaacccaaggcgcaggcggcuauucccuccaagcugacagaguugagguucuauucguuucucggaaaaagagaaaugagcuuugcagcauuuauaaggcaagauaaaaaggcgcaaaagcuuuggcuuaggaacuucuauacgguagaaaauauuaaaaccuuacaaaaaagacaagcugcagcugaugcagcauguaagaaacuauauaauuuagugggugagguagagcgggugcacaccaacgauaaggugcuggugcugguugcccaacgcuaccgcgagcggcugcuuaauguugguucuaagugcgcggugacgcuugauaaucccgaaaggcagcaaaaguuggccgauguguacgaggugcagaaugccuggcugucuauucguuucgaugauuuggauuuuacccuuacccaugucaaccucuccaaccuccgcaaggccuauaaccuuauaccacggaagcauauuuuggcuuuuaaggaguauuuggauaaccgcguaaagcaaaagcugugcgaggagugccgaaauguaaggaggaaggaggaucucugcacuuguugcagcccccgcuacucuaauuuaaccagcuggcuaaaggagaaccacagcgagucgucgauagagcgcgaagcggccaccaugaugcugcucgauguggagcgcaagcugcuaagcuuccuacuagacgagcgaaggaaggcuauuaucgaguacggaaaguuuauuccuuuuagugcguugguaaaggagugccguuuggcagaugcugguuugugcgguauccgcaacgaugugcugcacgauaacguaaucucguaugccgaugccauagguaagcuaagugccuacuucccgaaggaggccagcgaggccguggaguauauuaggcguacaaaggagguaagggagcaacguagagaggagcuuauggcuaauagcucgcaguaa

SEQ ID NO: 11051 - RNA, 3348 nt, Artificial Sequence
  Cas13b variant__Bacteroides pyogenes__ERI81700.1__Cas13b
auggaaucaaucaagaacucacagaaaucaaccgguaaaacuuugcagaaggauccgccauauuucgggcuauaucuuaauauggcauugcuuaaugugcggaaaguagagaaucauauucguaaaugguuaggagauguagcuuugcuucccgagaaaucaggcuuucauucacuuuugacaacugauaacuugucuucugcaaaguggacgcgcuucuauuauaaaagccggaaauuccuuccuuuucuugaaauguucgacagugacaagaagaguuaugaaaaucgucgagaaacaacagaaugucuugauacuauagaccgacagaaaauaucuucccuguuaaaagaggucuaugggaaacuccaagauauucguaaugcguucucucauuaucauaucgacgaucaaucagugaagcauacagcacucaucaucucaagugagaugcaucguuuuauugaaaaugcuuacucuuuugcuuugcagaagacccgcgcucguuuuaccggaguuuuuguagaaacagauuucuugcaagcugaagagaagggugacaauaaaaaguuuuuugccaucggugguaaugaaggaauaaaacugaaagacaacgcuuugauuuuccuuauaugucuuuuucuugauagagaggaggcuuucaaguuucucagccgugcgaccggauuuaaaaguaccaaagagaaggguuuucuugcuguccgagagacguuuugcgcucucuguugccgccaaccgcacgaacgccugcuuagugucaaucccagagaagcguugcugauggauaugcugaaugaacugaaucgcugccccgauauccuuuucgagauguuggacgagaaggaccaaaagucuuuuuugccguuguugggagaagaagaacaagcacauaucuuggaaaacagccuaaacgaugagcuaugugaagcgaucgaugauccuuucgagaugauugcuuccuugaguaaaagggugcgcuacaaaaaucgcuuuccuuaucugaugcucagguauauugaagaaaagaaucuacugccguucauucguuuucguaucgaccuuggauguuuggaauuggccucauaucccaaaaagaugggagaggagaauaacuaugaacguagcgucacggaucacgcuauggcauucggucguuugaccgauuuccauaaugaagaugcgguuuuacagcagauaaccaaagguauaacugacgaagugcgcuuuucucuguaugcaccacgauacgcaauuuauaacaauaagauaggauuuguccggacaggugguagugauaaaauuucuuuuccgacgcucaagaagaagggaggagaggggcauuguguggcauauacucugcaaaauacgaaaucuuuuggguuuauuaguauauaugauuugcggaaaaucuugcugcuuucuuuuuuagauaaggauaaggcuaaaaacauuguuucuggacuuuuggaacaaugugaaaaacauuggaaagaucuaagugagaaucuguucgaugcaauuagaacagaacuacaaaaggaauuuccuguuccuuugauuagauacacccugccucgaaguaaagguggaaaacuuguuaguucgaaauuagcggauaagcaggaaaaguaugaaagugaguucgaaagacguaaagaaaaacucacugaaauacucucggagaaagacuuugauuuaucucaaauuccucgccggaugauugaugaaugguugaauguuuugccuacuucaagagaaaagaaacuaaaagguuauguggaaacacugaagcuggacugucgggagcguuugcggguuuucgaaaaacgggagaaaggugagcauccugugccaccucgcauuggcgaaauggcuaccgauuuagcgaaagauauuauccgcaugguuaucgaccaaggggugaagcaacgcauaacgucugcuuauuauucggagauacagcguugucuggcgcaauaugcgggcgacgauaaucgacgucauuuggauaguauaauucgagaguugaggcuuaaagacacgaaaaauggucauccuuuucuugggaaagugcuuagaccuggcuuggggcauacggagaaguuguaucagcgauacuucgaagagaaaaaagagugguuggaagcuacuuuuuauccggcagcaagcccgaaaagagugccgcgcuuugucaaucccccaacuggaaaacaaaaagaacugccuuuaauuauucguaauuugaugaaagaacggccggaguggagagauuggaaacagaggaaaaacagccauccgauagaucucccuucacagcuuuucgagaaugaaauuugucgauuguugaaagauaaaauugggaaggaaccuuccggaaaacugaaauggaacgaaauguucaaguuguauugggauaaagaauuucccaauggcaugcagagauuuuaucguuguaaaagaagaguugaaguauucgauaaggucguagaauaugaauacagugaagagggaggaaacuauaaaaaguauuaugaggcauugauagaugaaguugugaggcagaaaaucucuucuucuaaggaaaagagcaaacuccaaguagaagauuugacucuuucugugcgacguguguuuaagcgugcaaucaacgaaaaggaguaucagcuucgauugcuuugugaggacgaccgcuugcuguuuauggcuguaagagacuuguaugauuggaaggaagcgcagcuugacuuagauaaaauagacaauaugcugggggaaccgguuucugucagucaaguuauucaauuggaaggcggacagccugaugcagugauuaaagcagaguguaagcucaaagacguaucuaaguugaugcguuauuguuacgaugggcggguaaagggauugaugccuuauuuugcuaaccaugaagcaacacaagagcaaguggagauggaauugcgucauuacgaagaucaucgcaggcguguauuuaauugggucuuugcuuuggaaaaauccguauugaagaaugaaaaguugagaagguucuaugaagaaucucagggaggaugugagcaucgcagaugcauagaugcguugagaaaggcaucacucguuucggaagaagaauaugaguuucuuguccauauucguaauaagucugcucauaaucaauucccugacuuggaaauugggaagcugcccccgaacguuacaucugguuuuugcgaauguauauggaguaaauauaaagcaauaauuugucgaaucauuccuuuuauagaucccgaaagaagauuuuuugggaaacuuuuggagcagaaauaa

SEQ ID NO: 11052 - RNA, 3348 nt, Artificial Sequence
  Cas13b variant__Bacteroides pyogenes__WP_034542281.1__Cas13b
auggaaucaaucaagaacucacagaaaucaaccgguaaaacuuugcagaaggauccgccauauuucgggcuauaucuuaauauggcauugcuuaaugugcggaaaguagagaaucauauucguaaaugguuaggagauguagcuuugcuucccgagaaaucaggcuuucauucacuuuugacaacugauaacuugucuucugcaaaguggacgcgcuucuauuauaaaagccggaaauuccuuccuuuucuugaaauguucgacagugacaagaagaguuaugaaaaucgucgagaaacagcagaaugucuugauacuauagaccgacagaaaauaucuucccuguuaaaagaggucuaugggaaacuccaagauauucguaaugcguucucucauuaucauaucgacgaucaaucagugaagcauacagcacucaucaucucaagugagaugcaucguuuuauugaaaaugcuuacucuuuugcuuugcagaagacccgcgcucguuuuaccggaguuuuuguagaaacagauuucuugcaagcugaagagaagggugacaauaaaaaguuuuuugccaucggugguaaugaaggaauaaaacugaaagacaacgcuuugauuuuccuuauaugucuuuuucuugauagagaggaggcuuucaaguuucucagccgugcgaccggauuuaaaaguaccaaagagaaggguuuucuugcuguccgagagacguuuugcgcucucuguugccgccaaccgcacgaacgccugcuuagugucaaucccagagaagcguugcugauggauaugcugaaugaacugaaucgcugccccgauauccuuuucgagauguuggacgagaaggaccaaaagucuuuuuugccguuguugggagaagaagaacaagcacauaucuuggaaaacagccuaaacgaugagcuaugugaagcgaucgaugauccuuucgagaugauugcuuccuugaguaaaagggugcgcuacaaaaaucgcuuuccuuaucugaugcucagguauauugaagaaaagaaucuacugccguucauucguuuucguaucgaccuuggauguuuggaauuggcuucauaucccaaaaagaugggagaggagaauaacuaugaacguagcgucacggaucacgcuauggcauucggucguuugaccgauuuccauaaugaagaugcgguuuuacagcagauaaccaaagguauaacugacgaagugcgcuuuucucuguaugcaccacgauacgcaauuuauaacaauaagauaggauuuguccggacaagugguagugauaaaauuucuuuuccgacgcucaagaagaagggaggagaggggcauuguguggcauauacucugcaaaauacgaaaucuuuuggguuuauuaguauauaugauuugcggaaaaucuugcugcuuucuuuuuuagauaaggauaaggcuaaaaacauuguuucuggacuuuuggaacaaugugaaaaacauuggaaagaucuaagugagaaucuguucgaugcaauucgaacagaacuacaaaaggaauuuccuguuccuuugauaagauacacccugccucgaaguaaagguggaaaacuuguuaguucgaaauuagcggauaagcaggaaaaguaugaaagugaguucgaaagacguaaagaaaaacucacugaaauacucucggagaaagacuuugauuuaucucaaauuccucgccggaugauugaugaaugguugaauguuuugccuacuucaagagaaaagaaacuaaaagguuauguggaaacauugaagcuggacugucgggagcguuugcggguuuucgaaaaacgggagaaaggugaacauccucugccaccucgcauuggcgaaauggcuaccgauuuagcgaaagauauuauccgcaugguuaucgaccaaggggugaagcaacgcauaacgucugcuuauuauucggagauacagcguugucuggcacaauaugcgggcgacgauaaucgacgucauuuggauaguauaauucgagaguugaggcuuaaagacacgaaaaauggucauccuuuucuugggaaagugcuuagaccuggcuuggggcauacggagaaguuguaucagcgauacuucgaagagaaaaaagagugguuggaagcuacuuuuuauccggcagcaagcccgaaaagagugccgcgcuuugucaaucccccaacuggaaaacaaaaagaacugccuuuaauuauucguaauuugaugaaagaacggccggaguggagagauuggaaacagaggaaaaacagccauccgauagaucucccuucacagcuuuucgagaaugaaauuugucgauuguugaaagauaaaauugggaaggaaccuuccggaaaacugaaauggaacgaaauguucaaguuguauugggauaaagaauuucccaauggcaugcagagauuuuaucguuguaaaagaagaguugaaguauucgauaaggucguagaauaugaauacagugaagagggaggaaacuauaaaaaguauuaugaggcauugauagaugaaguugugaggcagaaaaucucuucuucuaaggaaaagagcaaacuccaaguagaagauuugacucuuucugugcgacguguguuuaagcgugcaaucaacgaaaaggaguaucagcuucgauugcuuugugaggacgaccgcuugcuguuuauggcuguaagagacuuguaugauuggaaggaagcgcagcuugacuuagauaaaauagacaauaugcugggggaaccgguuucugucagucaaguuauucaauuggaaggcggacagccugaugcagugauuaaagcagaguguaagcucaaagacguaucuaaguugaugcguuauuguuacgaugggcggguaaagggauugaugccuuauuuugcuaaccaugaagcaacacaagagcaaguggagauggaauugcgucauuacgaagaucaucgcaggcguguauuuaauugggucuuugcuuuggaaaaauccguauugaagaaugaaaaguugagaagguucuaugaagaaucucagggaggaugugagcaucgcagaugcauagaugcguugagaaaggcaucacucguuucggaagaagaauaugaguuucuuguccauauucguaauaagucugcucauaaucaauucccugacuuggaaauugggaagcugcccccgaacguuacaucugguuuuugcgaauguauauggaguaaauauaaagcaauaauuugucgaaucauuccuuuuauagaucccgaaagaagauuuuuugggaaacuuuuggagcagaaauaa

SEQ ID NO: 11053 - RNA, 3675 nt, Artificial Sequence; identical to SEQ ID NO: 11044
  Cas13b variant__Bergeyella zoohelcum__WP_002664492.1__Cas13b

SEQ ID NO: 11054 - RNA, 3600 nt, Artificial Sequence
  Cas13b variant__Capnocytophaga canimorsus__WP_013997271.1__Cas13b
augaaaaauauacagagauuaggcaaaggaaaugaguuuucuccauuuaaaaaagaagauaaauucuauuucggaggauuuuuaaauuuagcuaauaauaauauugaggauuucuuuaaggaaauaaucacucguuuuggcauuguuauuacagaugaaaauaaaaaaccaaaagaaacuuuuggagagaaaauuuugaaugaaauuuuuaaaaaagacauuucuauuguagauuacgaaaaauggguaaauauauucgcugauuauuuuccuuuuacuaaauauuuaaguuuauauuuagaagaaaugcaguuuaaaaacagagugauuuguuuucgugauguaaugaaagaauugcuaaaaacuguagaagcuuuacgaaauuuuuacacccacuacgaccacgagccaauuaaaauugaagaucguguguuuuauuucuuagauaaaguuuuacuugauguuucucucacaguaaaaaacaaauaucugaaaacagauaagacaaaggaguuucuuaaucaacauauaggagaagaauuaaaagaguuaugcaagcaaagaaaagauuauuuaguuggaaaagggaaacgaaucgauaaagaaagcgaaauuauuaaugguaucuauaauaacgcuuuuaaagauuuuauuugcaaaagagaaaaacaagacgauaaagaaaaucauaauuccguggagaagauucuuuguaauaaagaaccucaaaauaagaaacaaaaaucuagugcaacggugugggaacuuuguucaaaaagcaguucaaaauauacugagaaaaguuuuccaaauagagaaaaugacaaacauugcuuagaaguuccuauuucacaaaaaggaauuguauuucuucuuucguucuuuuugaauaagggggaaauuuaugcuuuaacuucaaauauaaaaggguucaaggcuaaaauuacuaaagaagaaccuguuacauaugacaaaaacaguauucguuauauggcaacacauagaauguuuucuuucuuggcauauaaaggauuaaaaagaaaaauucguacuucugagauaaauuauaacgaagauggucaagcuucaaguacuuaugaaaaagaaacuuugaugcuacagaugcucgaugaauugaacaaaguacccgauguggucuaucagaauuugagcgaagauguacaaaaaacuuucaucgaagauuggaaugaauaccuaaaagagaacaauggcgauguagggacaauggaagaagagcagguaauucauccagugauucgcaagcguuacgaagauaaauucaauuauuuugccauucgauuuuuagaugaguuugcucaguucccuacgcuucguuuucaggugcauuuagggaauuaucuuugugauaaacgaacaaaacaaauaugcgauaccaccacggaaagagaaguaaagaaaaagauuaccguguuuggaagacucucggaauuggaaaauaagaaagccaucuuucuaaacgagagagaagaaauuaaaggaugggaaguuuuuccuaacccaaguuaugauuuuccuaaggaaaauauuuccguuaauuauaaagauuuuccuaucguggguaguauuuuggacagggaaaaacaaccuguuuccaauaaaauagguaucagaguaaagauagcagaugaguugcaaagagaaauagauaaggcuauuaaagaaaaaaaacuaagaaauccgaaaaauagaaaagcaaaccaagacgagaagcaaaaagaaagguugguuaaugaaaucguaaguacaaacaguaacgaacaaggagaaccagugguauucauugggcaacccacggcuuaucugaguaugaaugauauucauucgguuuuguaugaauuuuuaauaaauaagauaucaggagaagcauuagaaacgaaaaucguagaaaaaauagaaacucaaaucaagcagauuauaggaaaagaugccacuacuaaaauucuaaaaccuuauaccaaugcuaauucuaacucuaucaaccgagagaaguuguuaagagaccuugagcaagaacaacaaauuuuaaaaacacuucucgaggagcagcaacagagagagaaagacaaaaaagacaaaaaaucuaaacgaaaacacgaacuuuaucccucugaaaaaggaaaaguagcgguuugguuggcgaaugacaucaagcgcuuuaugccaaaggcguuuaaggagcaauggcguggguaccaucauagcuugcugcaaaaguauuuagcauauuacgaacaaaguaaagaggaauugaaaaaucuuuuaccaaaagaaguauuuaagcauuuuccuuuuaaauugaagggguauuuucagcaacaauauuugaaucaauucuacacugauuauuuaaaaagacgauuaucauauguaaaugaauuauuacuaaauauucaaaauuucaaaaaugauaaagaugccuuaaaagcaacagaaaaagaguguuucaaauucuuuagaaaacaaaauuauauuauuaauccgauaaacauucaaauucagucgauauugguauauccaaucuucuuaaagagaggauuuuuagaugagaaaccaacaaugauugacagagaaaaguuuaaagaaaauaaagauacugaacuugcggauugguuuaugcauuauaaaaauuacaaagaagauaauuaucaaaaauuuuaugcguauccuuuagaaaaaguagaagagaaagagaaauuuaaaagaaacaagcaaauuaacaaacaaaaaaagaaugauguuuauacgcugaugaugguagaauacaucauacaaaagauauucggagacaaauuuguugaggagaauccgcugguauugaaggggauuuuucaaucaaaagcagaacgacagcaaaacaauacacacgccgccacuacacaagagcgaaaucuuaaugggauuuugaaccagccgaaggacaucaaaauucaagguaaaauaaccguaaaagguguaaagcuaaaagauauugggaauuucagaaaauaugagauugaccagcguguaaacaccuuuuuggacuacgagccucgaaaagaauggauggcauaucugccuaaugacuggaaagaaaaggaaaaacagggacaguugcccccuaauaauguuauagauagacaaauaaguaaauaugaaaccguuagaagcaaaauuuugcuaaaagauguacaagaauuggagaaaauaauuucugacgaaauuaaggaagaacacagacacgauuugaagcaaggaaaauauuauaauuucaaguacuauauucucaacggucuuuuaagacagcuuaaaaaugaaaauguggagaauuacaagguauuuaaguugaauacuaauccugaaaaagugaauaucacccaacuaaaacaagaagcaaccgauuuagaacaaaaagcuuuuguuuuaaccuauauucguaauaaauuugcacacaaccaauugccuaaaaaagaauuuugggacuauugccaagaaaaauacggcaaaauagaaaaagaaaaaaccuacgccgaguacuuugcugagguauuuaaaagggaaaaagaagcacugauaaaguaa

SEQ ID NO: 11055 - RNA, 3657 nt, Artificial Sequence
  Cas13b variant__Capnocytophaga cynodegmi__WP_041989581.1__Cas13b
auggaaaauaaaacaucuuuagggaauaauauuuauuacaacccuuuuaaaccacaggauaaaucuuauuuugcggguuaucucaaugcagcaauggaaaauauagauaguguauuuagagaauugggaaaaagauuaaaaggcaaagaauacacuucagagaauuuuuuugaugcuaucuuuaaggaaaacauuucauuaguggaauacgaaagguaugugaaauugcuuucggauuauuucccuauggcucgucuuuuggauaaaaaagaaguuccuauaaaagaacgaaaagaaaauuuuaaaaagaauuucagaggcauuauaaaagcgguaagagauuuaagaaacuuuuauacgcauaaggaacacggggagguagaaauuacagaugaaauauuuggaguauuggaugaaaugcugaaaagcacgguuuuaacggugaaaaagaaaaaaauaaaaaccgauaaaacaaaagaaauucugaaaaaaagcauagaaaaacaauuggauauuuuaugccaaaagaaauuagaauaucuaaaagacacagcaagaaaaauagaggagaagcguagaaaucaaagagaaagaggagagaaaaaauuggugccucgauucgaauacagugacagaagggaugauuuaauagcagcgauuuauaaugacgcuuuugauguuuauaucgauaagaaaaaagauagccuaaaagaaucgaguaaaacaaaauacaauaccgaaagcuacccucaacaagaagaaggcgauuugaaaauuccaauuucaaaaaacggaguggucuuccugcuuucuuuguuucucuccaaacaagaaguacacgcauucaaaucuaaaauagcaggguuuaaggcaaccguuaucgaugaagcaacggugagccauagaaaaaacagcauuuguuuuauggcuacgcacgaaauuuucucgcauuuggcuuacaaaaaauugaagcgaaaaguaagaacggcugaaaucaacuauagugaggcagaaaaugcugaacagcuuuccauuuacgccaaagaaacucuaaugaugcagaugcucgaugaauugagcaaaguacccgauguggucuaucaaaauuugagcgaagauguacaaaaaacuuucaucgaagauuggaacgaauaccuaaaagaaaacaauggcgauguagggacaauggaagaagagcagguaauucauccagugauucgcaagcguuacgaagauaaauucaauuauuuugccauucgauuuuuagaugaguuugcucaguucccuacgcuucguuuucaggugcauuuagggaauuaucuucaugauucucgcccuaaggaacaucugauuuccgaccgaagaauaaaagaaaaaaucaccguuuucggcaggcuuucggaauuggagcauaaaaaagcauuguuuauaaaaaacaccgaaaccaacgaagauagaaaacacuauugggaaguuuuuccuaaccccaauuaugauuuuccuaaggaaaauauuuccguuaaugauaaagauuuuccuaucgcggguaguauuuuggacagagagaaacagccuaccgcagggaagauagggauaaaagugaauuugcuuaaccaaaaauacauuucagaaguagauaaagccguaaaagcccaucagcucaagcaaagaaacaacaagccgucuauccagaacauuauagaagaaauagugccaaucaauggaagcaauccaaaagaaauuauuguuuucggugggcaacccacggcuuaucugaguaugaaugacauucauuccauuuuguaugaguuuuucgauaaaugggagaaaaagaaagaaaaguuagaaaagaaaggugaaaaagaauuaagaaaggaaauuggaaaagaguuagaagagaaaaucguaggaaaaauucaaacucaaauucagcaaaucauagauaaagauaucaaugccaagauauuaaaaccuuaucaagacgaugauucuacugcuauugauaaagagaaauugauaaaagauuugaagcaggagcaaaagauuuuacaaaaauuaaaaaacgaacaaacggcucgugaaaaagaauaucaagaauguauugcuuaucaagaagaaagucgaaaaauaaaaagaagugauaaaagucgucaaaaauacuugagaaaucaacuuaaacgaaaguauccugaaguuccuacacgaaaagaaauucuuuauuaucaggaaaaagggaaaguagcgguuugguuggcgaaugacaucaaacgcuuuaugccuaccgauuuuaaaaacgaauggaaaggggaacagcacagcuuguugcaaaaaucauuggcguacuaugaacaauguaaagaggaguugaaaaaucuuuugccccaacaaaaaguauuuaagcauuuaccuuuugaguuggggggacauuuucagcaaaaauauuuguaccaauuuuacacucguuauuuagauaaacgauuggagcauaucagugggcuggugcaacaagccgaaaacuuuaaaaacgaaaauaaagucuucaaaaagguagaaaaugaauguuuuaaauucuugaaaaaacaaaauuauacucacaaaggcuuagacgcucaagcucaguccguauugggauauccgauuuuuuuagaaagaggauuuauggaugaaaaaccuacgauaauuaaaggaaaaacuuuuaaaggaaacgaaagucuuuuuaccgauugguucagauauuacaaggaauaucagaauuuucagacauuuuaugauacugaaaauuauccgcuuguagaauuggaaaaaaaacaagcagaccgaaaacgagaaaccaaaaucuaccaacaaaagaaaaacgauguguuuacacuuuugauggcgaaacauauuuucaaaucgguauucaagcaggauagcaucgaccgguuuucguuagaagacuuguaucagucucgggaggaacgccuagaaaaucaggagaaagccaagcaaacgggugagcgaaauaccaacuauauuuggaacaaaaccguugauuuaaacuugugugacggaaaaguuacgguagaaaauguaaaacugaaaaauguggguaauuucauaaaauaugaauacgaccaaaggguucaaacuuucuuaaaauaugaggaaaauauaaaauggcaggcguuucuaaucaaagaaaguaaggaagaggaaaauuauccguacauaguggaaagagaaauagaacaguaugaaaaaguaagaagagaagaacugcugaaggaaguccaccuuauagaggaauauauuuuagaaaagguaaaagauaaggaaauauuaaaaaaaggggauaaucaaaauuucaaauacuacauucucaacggacuuuuaaagcaacuuaaaaaugaagauguggagagcuauaagguauucaacuuaaauacuaaaccugaagaugugaacauuaaccaacuaaaacaagaagcaaccgauuuagaacaaaaagccuuuguuuuaaccuauauucguaauaaauuugcacacaaccaauugccuaaaaaagaauuuugggacuauugccaagaaaaauauggcaaaauagaaaaagaaaaaaccuaugccgaguacuuugcagaaguauuuaaaagggaaaaagaagcacugaugaaguaa

SEQ ID NO: 11056 - RNA, 3438 nt, Artificial Sequence
  Cas13b variant__Chryseobacterium sp.__WP_047431796.1__Cas13b
auggaaacccaaacaaucggucauggaauugccuaugaucauucuaaaauacaagacaaacauuuuuuuggaggauucuuaaauuuagcugagaauaauauuaaggcuguacuaaaagcuuuuucagaaaaauuuaauguugguaauguugaugugaaacaguucgcugaugucucucuaaaggauaaucuccccgacaacgacuuucaaaagagaguaucuuuuuuaaaaauguauuucccgguuguugauuuuaucaauaucccaaauaauagagcaaaguucagaucagaucuuacuacacuuuuuaaaucaguagaucaacuaagaaauuuuuauacgcauuauuaucacaagccuuuagauuuugaugcuucucuuuuuauucuuuuggaugauauuuuugcuagaacagcuaaggaagugagagaccagaagaugaaagaugauaagaccagacaauuguuaaguaaauccuuaucagaagaacugcaaaaaggguaugagcugcagcuggagagauuaaaggaauugaaucgacuagggaaaaaaguuaacauacaugaucagcugggaauuaaaaaugguguccuuaacaacgcuuucaaucacuuaauuuauaaagacggugagucuuuuaaaacaaagcucacuuacaguucagcacugaccuccuucgaaucggcugaaaacgguauugaaaucucucaaagcggccuuuuauuucuucucaguauguuucuuaagaggaaggaaauugaagaucuaaaaaauagaaauaaaggauuuaaagcuaaagugguaauagaugaagauggaaagguaaauggucuuaaauuuauggcuacccacuggguuuuuuccuaucuauguuuuaaaggacucaaaucgaaguuauccacugaauuucacgaagaaacauuauuaauucagauuauugaugagcucaguaaaguuccagaugagcuuuauugugcguuugauaaagaaaccagagacaaauuuauagaagauauuaaugaguacguuaaggaaggacaccaggauuuuaguuuggaagaugcuaaagucauucauccugucauucguaaacgcuaugaaaauaaguucaacuauuuugcuauucgguuucuagaugaauuugugaaauucccuucgcuaagguuucagguucauguuggaaauuauguccaugacaggaggauaaaaaauauugauggaacaacauucgagacggaaaggguaguuaaggaccguauaaaaguuuucggaagacuuucagaaaucucuucuuauaaggcucaauaucucaguucgguuucagauaaacaugaugaaacuggaugggaaauauuuccuaauccaucuuauguauuuaucaauaauaacauacccauucauauuucuguugauacgaguuuuaaaaaagagauugccgauuuuaaaaaacugagaagagcccaagugccggaugaauuaaagauaagaggugcugagaaaaagagaaaguuugaaauaacccaaaugaucgguagcaagucagugcuaaaccaggaagaaccgaucgcucuucuauccuuaaacgaaauucccgcucuuuuauaugaaauauuaauaaauggcaaggagccugcagaaauugaaagaauaauaaaagacaaacucaacgaaagacaggacgucauuaaaaauuauaauccugaaaauuggcuuccugcuucucagauaagcagaaggcugcgaagcaauaaaggagaaagaauuauaaauacagauaaauuacuucaauuagugacaaaagaauugcuuguuacggagcaaaagcugaagauaaucucggauaacagggaagcucuuaaacaaaagaaagaggguaaauauaucaggaaguuuauauuuacaaauucugagcuuggaagggaagcuauauggcucgccgaugauaucaaacguuuuaugccggcagauguacgaaaagaauggaaaggcuaccagcauagccaguugcaacagucauuagcuuucuauaacucacggcccaaagaagcauuggcaauucuagaaaguaguuggaaucuaaaagaugaaaagauaaucuggaaugaauggauauuaaagaguuuuacacaaaacaaauuuuuugaugcuuuuuauaaugaauauuugaagggaagaaagaaauauuuugcuuuucuaucugaacacauuguucaguauacuuccaaugcuaaaaaucuucaaaaguuuauaaagcaacagaugccaaaggacuuauucgaaaagcgucauuauauuauagaagauuuacagacagagaaaaauaaaauuuuguccaaacccuuuauuuuuccaagagguauuuuugauaaaaaaccaacuuuuauuaaaggugucaaggucgaagauagcccggaauccuuugcaaacugguaucaauaugguuaucaaaaagaucaucaauuucagaaauuuuaugauuggaaacgugauuacagugauguuuuuuuagaacaucuuggaaaaccuuuuauuaauaauggugauaggagaacucuugguauggaggaguuaaaagagcguauuauuauaaaacaggaucuuaaaauuaagaaaauuaagauacaggaucuguuucuaagacuuauagcugagaauuuguuucaaaaagucuuuaaguauuccgcaaaacuuccuuuaagugauuucuacuuaacccaggaagaaaggauggaaaaagaaaauauggccgcucuacaaaauguacgggaggaaggugacaaaagcccaaacaucauaaaagacaauuuuauauggagcaaaaugauuccauauaaaaaaggacagauaauugagaaugcuguuaagcuaaaagacaucggaaaguuaaauguuuuaucauuagaugauaaagugcagacgcucuuaucuuaugaugaugcaaaacccuggaguaagauugcauuggaaaaugaguuuucuauuggcgaaaauucuuaugagguaauaagacgggaaaaacuauucaaagaaauucagcaauucgaaucugaaauuuuauuucgaucagggugggauggcauuaaucaucccgcucaauuggaagauaacaggaacccaaaguuuaagauguauauuguuaauggaauuuuaagaaaaucugcaggacuauacagucaaggugaagauauuugguuugaauacaaugccgauuuuaauaaccuugaugcagauguuuuagaaacuaagucugaauugguacaauuggcuuuuuuagugacagcuauucgaaauaaauuugcucacaaucaacuuccggcaaaagaauuuuauuuuuauauuagggcuaaauauggauuugcagacgagcccucuguagcauuaguuuaccugaauuuuacaaaguaugcgauuaaugaauuuaaaaaggugaugauauag

SEQ ID NO: 11057 - RNA, 3453 nt, Artificial Sequence
  Cas13b variant__Flavobacterium branchiophilum__WP_014084666.1__Cas13b
auggaaaauuuaaauaaaauauuagauaaggaaaacgaaauuuguauuaguaaaauauuuaauacuaaagguauugcugcgccuauuacugaaaaagcuuuagauaauauaaaaaguaaacaaaaaaacgauuugaauaaagaagcaagauugcauuauuuuucaauaggucauucuuuuaagcagauagauacaaaaaaaguauuugauuauguuuugauugaagaacucaaagaugaaaaaccauuaaaguucauaacacuacaaaaagauuuuuucacaaaagaauuuagcauaaaacuucaaaaauuaauaaauucuaucagaaauauuaauaaccauuauguucauaauuuuaaugauauaaauuuaaacaagauagauucuaauguguuucauuuuuuaaaagaaaguuuugaauuagcaauuauugagaaauauuauaaaguaaauaaaaaauauccauuagacaaugaaauuguuuuauuuuuaaaagaauuauuuauuaaagaugaaaauacagcauugcuaaauuauuuuacuaauuuaucaaaagacgaagccauugaauauauuuuaacuuuuacaauuacugaaaauaaaauuuggaauauaaauaaugaacacaacauuuuaaauauugaaaagggaaaguacuuaaccuuugaagcaaugcuguuucuaauaacaaucuuccuuuauaaaaaugaagcgaaucauuuauuaccaaaauuguaugauuuuaaaaauaacaaaucaaaacaagaguuguuuacauuuuuuucaaagaaauuuacaagucaagauauugaugccgaagaaggucauuuaauaaaauuuagagauaugauucaguauuuaaaccauuauccgacagcauggaauaacgauuuaaaauuggaaucugaaaauaaaaacaaaauaaugacuacaaaacuaauagauagcauuauagaauuugaacuaaauaguaacuauccaaguuuugcaacagauauucaauuuaaaaaagaagcaaaagcguuuuuauuugcuucaaacaaaaaaaggaaucaaacuucauuuaguaauaaaucauacaacgaagagauuagacacaauccgcauauaaaacaauacagagaugaaauugcaagcgcucuuacgccaauuucuuuuaauguaaaagaagauaaauuuaagauauuugucaagaaacauguuuuagaagaguauuucccuaauagcauuggauaugaaaaguuuuuagaauauaacgacuucacagaaaaggaaaaagaagauuuugguuuaaaauuauauucaaauccgaaaacaaauaaauugauugaaagaaucgacaaucauaaacuaguaaagucgcauggaaggaaucaagacagauuuauggauuuuuccaugcguuuuuuagcugaaaacaauuauuuugguaaagaugcuuuuuucaaaugcuacaaauuuuaugauacucaagaacaagaugaauuuuugcaaagcaaugaaaacaaugaugauguaaaauuucauaaaggaaaaguuacuacuuauauuaaauaugaagagcauuuaaaaaauuacuccuauugggauuguccauuuguagaagaaaacaauucuaugaguguaaaaauaaguauugguagugaagaaaagauuuuaaaaauucaacgaaacuuaaugauuuauuuucuugaaaaugccuuauacaaugaaaauguagaaaaucaagguuauaaauugguaaauaauuauuaccgugaauuaaaaaaagauguugaagaaaguauagccucuuuagauuugauaaaauccaauccagauuuuaaaaguaaauacaaaaaaauucuucccaaaagacuuuuacauaauuaugcuccugcaaaacaagauaaagcuccagaaaaugcuuuugaaacauuauuaaaaaaagcagauuuuagagaagaacaauauaaaaaacucuuaaaaaaggcagaacaugaaaaaaacaaagaagacuuuguaaaacgaaauaaaggcaaacaauuuaaguugcauuuuauacgaaaagcuugucaaaugauguauuuuaaagaaaaauacaauacucugaaagaagguaaugcugcauuugaaaaaaaagacccaguuauugaaaaaagaaaaaacaaagaacaugaauuuggacaucauaaaaauuuaaacauuacacgagaggaguuuaaugauuauugcaaauggauguuugccuucaauggcaacgauuccuauaaaaaauauuuaagggauuuauuuucugaaaaacauuuuuuugauaaccaagaguauaaaaaccuauuugaaaguucuguuaauuuagaggcuuuuuaugcuaaaacaaaagaacuauuuaaaaaauggauugaaacaaauaagccaacaaauaaugaaaacagauauacacuugaaaacuauaaaaauuuaauauuacagaaacaaguuuucaucaauguauaucacuuuucaaaauauuuaauugauaaaaauuuauuaaauucagaaaacaaugugauucaauauaaaucauuagaaaauguagaauacuuaaucucggauuuuuauuuucaaaguaaauuaucaauagaccaauauaaaaccugugguaaauuauuuaacaaguuaaaaucaaauaaauuagaagauuguuugcucuaugaaauugcauacaauuauauugacaaaaaaaacguucauaaaauugauauucaaaaaauacuaacaucaaaaauaauucuuacuauaaaugaugcuaauacuccuuauaaaauaucgguucccuuuaauaaauuagagcgauauacagaaaugauugcaauaaaaaaucaaaacaaccuaaaagcucgauuuuuaauagauuugccuuuauaccuuucaaaaaauaaaauaaaaaaaggaaaagauagugcuggauaugaaauaauaauuaagaaugauuuagaaauugaagacauuaauacaauaaauaauaaaauuauaaaugauaguguaaaguuuacagagguauugauggaacuagaaaaauauuuuauauuaaaggauaaauguauuuuaucaaaaaauuauauugauaauagugagauaccaucauuaaaacaauuuucaaaaguuuggauaaaagaaaaugaaaaugaaauaauuaacuacaggaauauagcuugucauuuucauuuaccuuuauuagaaacuuuugauaaucuuuuauuaaauguggagcaaaaauuuaucaaagaagaauugcaaaacguuucuacuauaaacgacuuaucaaaaccucaggaguauuuaauuuuauuauucauuaaguuuaaacauaauaauuuuuacuugaauuuauuuaauaaaaaugaaaguaaaacaauaaaaaacgauaaagaaguaaaaaaaaauaggguuuugcaaaaauuuauaaaccaaguuauuuuaaaaaaaaaauaa

SEQ ID NO: 11058 - RNA, 3642 nt, Artificial Sequence
  Cas13b variant__Flavobacterium columnare__WP_060381855.1__Cas13b
augaguucaaaaaaugaaucuuauaacaaacaaaaaacuuuuaaccacuacaaacaagaagacaaauacuuuuuugguggcuuuuugaauaaugcugacgacaauuuaagacaaguuggcaaagaguucaaaacaaggauuaauuuuaaucacaacaauaaugaauuagcaaguguuuuuaaagauuauuucaacaaagaaaaaucaguugccaaaagagagcaugcguuaaacuuauuaaguaauuacuuuccuguuuuagaacgaauucaaaagcauacuaaucauaacuuugaacaaaccagagaaauuuucgaauuguuacuugauacaauaaaaaaauuaagagauuauuauacacaucauuaucacaaacccaucacuauuaaucccaaagucuaugauuuuuuagaugacaccuuauuagauguuuuaauuacaauuaaaaaaaagaaaguaaaaaacgauaccucuagagaacuacuaaaagaaaaauuuagaccugaauuaacacaauuaaaaaaucaaaaaagagaagaguuaauuaaaaaaggcaaaaaacuauuagaagaaaauuuagaaaaugcaguuuucaaucacugucuaagaccuuuuuuagaggaaaacaaaacagaugauaaacaaaacaaaacaguuucuuuacgaaaauauagaaaaucuaaaccaaacgaagaaacaucgauuacguugacccaaaguggauuagucuuuuuaaucucuuucuuuuuacaucgaaaagaguuucaaguuuucacaucuggauuagaaggauuuaaggcaaaaguaaacacuauuaaggaagaagaaaucucuuuaaauaaaaacaauauuguauacaugauuacacauuggucguauucauauuacaauuuuaaagguuuaaaacaucguauaaaaacagaccaaggcguuagcacacuugaacaaaacaauacuacacacagcuuaacaaauacuaauacaaaagaagcucuacuaacucaaauaguagacuacuugaguaaaguaccaaaugaaaucuacgaaacucuuucugaaaaacaacagaaagaguuugaagaagacauaaaugaguauaugcgugagaauccagaaaaugaggacucaacuuuuucaucaauaguuucucacaaagucauucgcaaacgcuaugaaaauaaguucaacuauuuugcaaugcgcuuuuuagaugaauacgccgaacuaccuacauugcgauuuauggucaauuuuggcgacuauauuaaagaucgucaaaagaaaauauuggaaucuauccaauuugauuccgaaagaaucaucaaaaaagaaauccaucuuuuugaaaaacugggucuaguuacugaauauaaaaaaaacguauacuuaaaagaaacuuccaauauagaccuuagucguuuuccuuuauuuccuagucccaguuauguaauggcuaauaacaauauaccuuuuuauauagauagcagaaguaacaacuuagaugaauaucuaaaccaaaagaaaaaagcgcaaagucaaaacagaaaaaggaaucuuacuuuugaaaaguauaacaaagaacaaucuaaagaugcuauuauagcaaugcuucaaaaagaaauugguguaaaagauuuacaacaaagaaguacuauaggguuauuaagcugcaacgaacugccuaguaugcuuuaugaagugauuguuaaagauauuaaaggagcugaacuugaaaacaaaauugcucaaaaaauaagagaacaauaccaaaguaucagagauuucacccuugauaguccucaaaaagacaacauaccaacuacauuaacaaaaacaauaagcacagacacgucaguuacuuuugaaaaucaacccauagauaucccucguuuaaaaaaugcucuucaaaaagaauuaacguuaacacaagaaaaacuucuaaauguuaagcaacaugaaauugaaguagacaauuacaacagaaauaagaauacauauaaauuuaagaaucagccaaaagauaaaguugaugauaauaaacuccaacguaaauauguauuuuaucguaacgaaauuggacaagaagcuaauugguuagccagcgaccuuauccauuuuaugaaaaacaaaucguuauggaaaggguacaugcauaacgaauuacaaucauuuuuagccuuuuuugaagauaaaaaaaaugacuguauagccuuauuagaaacuguuuuuaaccuaaaagaagauuguauuuuaacaaaagacuuaaaaaauuuauuucucaagcaugguaauuuuauugauuucuauaaagaauauuuaaaauuaaaagaagacuucuugaauacugaaucuacuuuuuuagaaaauggguuuauuggguuaccaccaaaaauuuuaaaaaaagaauuaucaaaaaggcucaacuauauauucauuguauuucaaaaacgccaauuuauaauuaaagaauuagaagaaaagaaaaacaauuuauaugcugaugccaucaauuuaucccgcgguauauuugacgagaaaccuacaaugauuccguuuaaaaaaccaaauccagaugaguuugcuucuugguuugucgcaucuuaucaauacaacaauuaucaaucuuuuuaugaauugacaccagacaaaauagagaaugauaaaaagaaaaaauacaaaaaccuacgagcgauuaacaaaguaaaaauucaagacuauuauuuaaaauuaaugguagauacuuuguaucaagacuuguucaaucagccauuagacaaauccuuaucagauuuuuauguuuccaaaacagauagagaaaaaauaaaagccgaugccaaagcuuaccaaaagcgcaacgauagcuucuuauggaauaaagucauccauuuaucuuuacaaaauaauaggauuacugcuaauccgaaacugaaagacauaggaaaauacaagagagcccugcaagaugaaaaaauagccacgcuacuuacuuaugaugauagaacguggacguaugccuuacaaaaaccugagaaggaaaaugaaaacgauuauaaagaauugcacuauaccgcacuuaauauggaauugcaagaguaugaaaaagugcguaguaaaaaacuacuaaaacaaguacaagaauuagagaaacagauuuuagauaaauuuuaugauuuuucuaauaaugcuacucauccugaagauuuagaaauugaggauaaaaaaggaaaaagacacccuaauuuuaaacuuuacauuacaaaagccuuauuaaaaaaugaaucugaaaucauaaauuuagaaaacauagauauugaaauuuuaauuaaauauuaugauuauaauacugaaaaguugaaggaaaaaauaaaaaauauggaugaggaugaaaaagccaaaauaguuaauacuaaagagaauuauaacaaaauaaccaauguuuuaauuaaaaaagcacuuguuuuaauuaucauucgcaacaaaauggcgcacaaucaauauccaccuaaauuuauuuacgauuuagcgacucguuuuguuccaaaaaaagaagaagaauacuuugcuugcuauuucaaccgaguuuuugaaaccauaacaacagaauuaugggaaaacaaaaaaaaagcuaaagaaauaguuuaa

SEQ ID NO: 11059 - RNA, 3540 nt, Artificial Sequence
  Cas13b variant__Flavobacterium columnare__WP_014165541.1__Cas13b
augaguucaaaaaaugaaucuuauaacaaacaaaaaacuuuuaaccacuacaaacaagaagacaaauacuuuuuugguggcuuuuugaauaaugcugacgacaauuuaagacaaguuggcaaagaguucaaaacaaggauuaauuuuaaucacaacaauaaugaauuagcaaguguuuuuaaagauuauuucaacaaagaaaaaucaguugccaaaagagagcaugcguuaaacuuauuaaguaauuacuuuccuguuuuagaacgaauucaaaagcauacuaaucauaacuuugaacaaaccagagaaauuuucgaauuguuacuugauacaauaaaaaaauuaagagauuauuauacacaucauuaucacaaacccaucacuauuaaucccaaaauauaugauuuuuuagaugacaccuuauuagauguuuuaauuacaauuaaaaaaaagaaaguaaaaaacgauaccucuagagaacuacuaaaagaaaaacuuagaccugaauuaacacaauuaaaaaaucaaaaaagagaagaguuaauuaaaaaaggcaaaaaacuauuagaagaaaauuuagaaaaugcaguuuucaaucacugucuaagaccuuuuuuagaggaaaacaaaacagaugauaaacaaaacaaaacaguuucuuuacgaaaauauagaaaaucuaaaccaaacgaagaaacaucgauuacguugacccaaaguggauuagucuuuuuaauguccuucuuuuuacaucgaaaagaguuucaaguuuucacaucuggauuagaaggauuuaaggcaaaaguaaacacuauuaaggaagaagaaaucucuuuaaauaaaaacaauauuguauauaugauuacacauuggucguauucauauuacaauuuuaaagguuuaaaacaucgcauaaaaacagaccaaggcguuagcacccuugaacaaaacaauacuacacacagcuuaacaaauacaaauacaaaagaagcccuacuaacucaaauaguagacuacuugaguaaaguaccaaaugaaaucuacgaaacccuuucugaaaaacaacagaaagaguuugaagaagacauaaaugaguauaugcgugagaauccagaaaaugaggacucaacuuuuucaucaauaguuucucacaaagucauucgcaaacgcuaugaaaauaaguucaacuauuuugcaaugcgcuuuuuagaugaauacgccgaacuaccuacauugcgauuuauggucaauuuuggcgacuauauuaaagaccgucaaaagaaaauauuggaaucuauccaauuugauuccgaaagaaucaucaaaaaagaaauccaucuuuuugaaaaacugaguuuaguuacugaauauaaaaaaaacguauacuuaaaagaaacuuccaauauagaccuuagucguuuuccuuuauuuccuaaucccaguuacguaauggcuaauaacaauauaccuuuuuauauagauagcagaaguaacaacuuagaugaauaucuaaaccaaaagaaaaaagcgcaaagucaaaacaaaaaaaggaaucuuacuuuugaaaaguauaacaaagaacaaucuaaagaugcuauuauagcaaugcuucaaaaagaaauugguguaaaagauuuacaacaacgaaguacuauuggguuauuaaguugcaacgaacugccuaguaugcuuuaugaagugauuguuaaagauauuaaaggagcugaacuugaaaauaaaauugcucaaaaaauaagagaacaauaccaaaguauuagagauuucacccuugauaguccucaaaaagacaacauaccaacuacacuaauaaaaacaauaaacacagacucgucaguuacuuuugaaaaucaacccauagauaucccucguuuaaaaaaugccauucaaaaagaauuaacguuaacacaagaaaaacuucuaaauguuaaggaacaugaaauugaaguggacaacuacaacagaaauaagaauacauauaaauuuaagaaucagccaaaaaauaaaguugaugauaaaaaacuccaacguaaauauguauuuuaucguaacgaaauucgacaagaagcuaauugguuagccagcgaccuuauccauuuuaugaaaaacaaaucgcuauggaaaggauacaugcauaacgaauuacaaucauuuuuagccuuuuuugaagauaaaaaaaaugacuguauagccuuauuagaaacuguuuuuaaccuaaaagaagauuguauuuuaacaaaaggcuuaaaaaauuuauuucucaagcaugguaauuuuauugauuucuacaaagaauauuuaaaauuaaaagaagacuucuugaauacugaaucuacuuuuuuagaaaauggucuuauaggauuaccuccaaaaauuuuaaaaaaagaauuaucaaaaagguucaaauauauauucauuguauuucaaaaacgccaauuuauaauuaaagaauuagaagaaaagaaaaacaauuuauaugcugaugccaucaauuuaucccgugguauauuugacgagaaaccuacaaugauuccguuuaaaaaaccaaauccagaugaguuugcuucuugguuugucgcaucuuaucaauacaacaauuaucaaucuuuuuaugaauugacaccagacauuguagagagagauaaaaagaaaaaauacaaaaaccuacgagcuauuaacaaaguaaaaauucaagacuauuauuuaaaauuaaugguagauacuuuguaucaagacuuguucaaucagccauuagacaaauccuuaucagauuuuuauguuucuaaagcagaaagagaaaaaauaaaagccgaugccaaagcuuaccaaaagcgcaacgauagcuccuuauggaauaaagucauccauuuaucuuuacaaaauaauaggauuaccgcuaauccgaaacuaaaagacauaggaaaauacaagagagcccugcaagaugaaaaaauagccacgcugcuuacuuaugaugauagaacguggacguaugccuuacaaaaaccugagaaggaaaaugaaaacgauuauaaagaauugcacuauaccgcacuuaauauggaauugcaagaguaugaaaaagugcguaguaaagaacuacuaaaacaaguacaagaauuagagaagcaaauuuuagaagaguauacugauuuuuugaguacgcaaauacauccagccgauuuugaaagagagggcaauccaaauuuuaaaaaauauuuagcccauucuauuuuagaaaacgaagaugaucuugauaaacugccagaaaaaguagaagcaaugagggaacuagaugaaaccauuacuaauccaaucauuaaaaaagcgauuguguuaauuaucauucgcaacaaaauggcgcacaaucaauauccaccuaaauuuauuuacgauuuagcgaaucguuuugucccaaaaaaagaagaagaauacuuugcgaccuauuucaaccgaguuuuugaaaccauaacaaaagaauuaugggaaaacaaagagaaaaaagauaaaacacaggucuaa

SEQ ID NO: 11060 - RNA, 3642 nt, Artificial Sequence
  Cas13b variant__Flavobacterium columnare__WP_063744070.1__Cas13b
augaguucaaaaaaugaaucuuauaacaaacaaaaaacuuuuaaccacuacaaacaagaagacaaauacuuuuuugguggcuuuuugaauaaugcugacgacaauuuaagacaaguuggcaaagaguucaaaacaaggauuaauuuuaaucacaacaauaaugaauuagcaaguguuuuuaaagauuauuucaacaaagaaaaaucaguugccaaaagagagcaugcguuaaacuuauuaaguaauuacuuuccuguuuuagaacgaauucaaaagcauacuaaucauaacuuugaacaaaccagagaaauuuucgaauuguuacuugauacaauaaaaaaauuaagagauuauuauacacaucauuaucacaaacccaucacuauuaauccuaaaauauaugauuuuuuagaugacaccuuauuagauguuuuaauuacaauuaaaaaaaagaaaguaaaaaacgauaccucuagagaacuacuaaaagaaaaacuuagaccugaauuaacacaauuaaaaaaucaaaaaagagaagaguuaauuaaaaaaggcaaaaaacuauuagaagaaaauuuagaaaaugcaguuuucaaucacugucuaagaccuuuuuuagaggaaaacaaaacagaugauaaacaaaacaaaacaguuucuuuacgaaaauauagaaaaucuaaaccaaacgaagaaacaucgauuacguugacccaaaguggauuagucuuuuuaauguccuucuuuuuacaucgaaaagaguuucaaguuuucacaucuggauuagaaggauuuaaggcaaaaguaaacacuauuaaggaagaaaaaaucucuuuaaauaaaaacaauauuguauauaugauuacacauuggucguauucauauuacaauuuuaaagguuuaaaacaucguauaaaaacagaccaaggcguuagcacccuugaacaaaacaauacuacacacagcuuaacaaauacuaauacaaaagaagcucuacuaacucaaauaguagacuacuugaguaaaguaccaaaugaaaucuacgaaacucuuucugaaaaacaacagaaagaguuugaagaagacauaaaugaguauaugcgugagaauccagaaaaugaggacucaacuuuuucaucaauaguuucucacaaagucauucgcaaacgcuaugaaaauaaguucaacuauuuugcaaugcgcuuuuuagaugaauacgccgaacuaccuacauugcgauuuauggucaauuuuggcgacuauaucaaagaucgucaaaagaaaauauuggaaucuauccaauuugauuccgaaagaaucaucaaaaaagaaauccaucuuuuugaaaaacugggucuaguuacugaauauaaaaaaaacguauacuuaaaagaaacuuccaauauagaccuuagucguuuuccuuuauuuccuagucccaguuacguaauggcuaauaacaauauaccuuuuuauauagauagcagaaguaacaacuuagaugaauaucuaaaccaaaagaaaaaagcgcaaagucaaaauagaaaaaggaaucuuacuuuugaaaaguauaacaaagaacaaucuaaagaugcuauuauagcaaugcuucaaaaagaaauugguguaaaagauuuacaacaaagaaguacuauuggguuauuaagcugcaacgaacugccuaguaugcuuuaugaagugauuguuaaagauauuaaaggagcugaacuugaaaauaaaauugcucaaaaaauaagagaacaauaccaaaguauuagagauuucacccuuaauaguccucaaaaagacaacauaccaacuacauuaauaaaaacaauaagcacagacacgucaguuacuuuugaaaaucaacccauagauaucccucguuuaaaaaaugccauucaaaaagaauuagcguuaacacaagaaaaacuucuaaauguuaagcaacaugaaauugaagugaacaauuacaacagaaauaagaauacauauaaauuuaagaaucagccaaaagauaaaguugaugauaauaaacuccaacguaaauauguauuuuaucguaacgaaauuggacaagaagcuaauugguuagccagcgaccuuauccauuuuaugaaaaacaaaucguuauggaaaggguacaugcauaacgaauuacaaucauuuuuagcuuuuuuugaagauaaaaaaaaugacuguauagccuuauuagaaacuguuuuuaaccuaaaagaagauuguauuuuaacaaaagacuuaaaaaauuuauuucucaagcaugguaauuuuauugauuucuauaaagaauauuuaaaauuaaaagaagacuucuugaauacugaaucuacuuuuuuagaaaauggguuuauuggguuaccaccaaaaauuuuaaaaaaagaauuaucaaaaaggcucaacuauauauucauuguauuucaaaaacgccaauuuauaauuaaagaauuagaagaaaagaaaaacaauuuauaugcugaugccaucaauuuaucccgcgguauauuugacgagaaaccuacaaugauuccguuuaaaaaaccaaauccagaugaguuugcuucuugguuugucgcaucuuaucaauacaacaauuaucaaucuuuuuaugaauugacaccagacaaaauagagaaugauaaaaagaaaaaauacaaaaaccuacgagcgauuaacaaaguaaaaauucaagacuauuauuuaaaauuaaugguagauacuuuguaucaagacuuguucaaucagccauuagauaaauccuuaucagauuuuuauguuuccaaaacagauagagaaaaaauaaaagccgaugccaaagcuuaccaaaagcgcaacgauagcuucuuauggaauaaagucauccauuuaucuuuacaaaauaauaggauuacugcuaauccgaaacugaaagacauaggaaaauacaagagagcccugcaagaugaaaaaauagccacgcuacuuacuuaugaugauagaacguggacguaugccuuacaaaaaccugagaaggaaaaugaaaacgauuauaaagaauugcacuauaccgcacuuaauauggaauugcaagaguaugaaaaagugcguaguaaaaaacuacuaaaacaaguacaagaauuagagaaacagauuuuagauaaauuuuaugauuuuucuaauaaugcuacucauccugaagauuuagaaauugaggauaaaaaaggaaaaagacacccuaauuuuaaacuuuacauuacaaaagccuuauuaaaaaaugaaucugaaaucauaaauuuagaaaacauagauauugaaauuuuaauuaaauauuaugauuauaauacugaaaaguugaaggaaaaaauaaaaaauauggaugaggaugaaaaagccaaaauaguuaauacuaaagagaauuauaacaaaauaaccaauguuuuaauuaaaaaagcacuuguuuuaauuaucauucgcaacaaaauggcgcacaaucaauauccaccuaaauuuauuuacgauuuagcgacucguuuuguuccaaaaaaagaagaagaauacuuugcuugcuauuucaaccgaguuuuugaaaccauaacaacagaauuaugggaaaacaaaaaaaaagcuaaagaaauaguuuaa

SEQ ID NO: 11061 - RNA, 3645 nt, Artificial Sequence
  Cas13b variant__Flavobacterium columnare__WP_065213424.1__Cas13b
augaguucaaaaaaugaaucuuauaacaaacaaaaaacuuuuaaccacuacaaacaagaagacaaauacuuuuuugguggcuuuuugaauaaugcugacgacaauuuaagacaaguuggcaaagaguucaaaacaaggauuaauuuuaaucacaacaauaaugaauuagcaaguguuuuuaaagauuauuucaacaaagaaaaaucaguugccaaaagagagcaugcguuaaacuuauuaaguaauuacuuuccuguuuuagaacgaauucaaaagcauacuaaucauaacuuugaacaaaccagagaaauuuucgaauuguuacuugauacaauaaaaaaauuaagagauuauuauacacaucauuaucacaaacccaucacuauuaaucccaaaauauaugauuuuuuagaugacaccuuauuagauguuuuaauuacaauuaaaaaaaagaaaguaaaaaacgauaccucuagagaacuacuaaaagaaaaacuuagaccugaauuaacacaauuaaaaaaucaaaaaagagaagaguuaauuaaaaaaggcaaaaaacuauuagaagaaaauuuagaaaaugcaguuuucaaucacugucuaauaccuuuuuuagaggaaaacaaaacagaugauaaacaaaacaaaacaguuucuuuacgaaaauauagaaaaucuaaaccaaacgaagaaacaucgauuacguugacccaaaguggauuagucuuuuuaauguccuucuuuuuacaucgaaaagaguuucaaguuuucacaucuggauuagaaagauuuaaggcaaaaguaaacacuauaaaggaagaagaaaucucuuuaaacaaaaacaauauuguauauaugauuacacauuggucguauucauauuacaauuuuaaagguuuaaaacaucguauaaaaacagaccaaggcguuagcacccuugaacaaaacaauacuacacacagcuuaacaaauacaaauacaaaagaagcccuacuaacucaaauaguagacuacuugaguaaaguaccaaaugaaaucuacgaaacccuuucugaaaaacaacagaaagaguuugaagaagacauaaaugaguauaugcgugagaauccagaaaaugaggacucaacuuuuucaucaauaguuucucacaaagucauucgcaaacgcuaugaaaauaaguucaacuauuuugcaaugcgcuuuuuagaugaauacgccgaacuaccuacauugcgauuuauggucaauuuuggcgacuauauuaaagaccgucaaaagaaaauauuggaaucuauccaauuugauuccgaaagaaucaucaaaaaagaaauccaucuuuuugaaaaacugaguuuaguuacugaauauaaaaaaaacguauacuuaaaagaaacuuccaauauagaccuuagucguuuuccuuuauuuccuaaucccaguuacguaauggcuaauaacaauauaccuuuuuauauagauagcagaaguaacaacuuagaugaauaucuaaaccaaaagaaaaaagcgcaaagucaaaacaaaaaaaggaaucuuacuuuugaaaaguauaacaaagaacaaucuaaagaugcuauuauagcaaugcuucaaaaagaaauugguguaaaagauuuacaacaacgaaguacuauuggguuauuaaguugcaacgaacugccuaguaugcuuuaugaagugauuguuaaagauauuaaaggagcugaacuugaaaauaaaauugcucaaaaaauaagagaacaauaccaaaguauuagagauuucacccuugauaguccucaaaaagacaacauaccaacuacacuaauaaaaacaauaaacacagacucgucaguuacuuuugaaaaucaacccauagauaucccucguuuaaaaaaugcucuucaaaaagaauuaacguuaacacaagaaaaacuucuaaauguuaaggaacaugaaauugaaguggacaacuacaacagaaauaagaauacauauaaauuuaagaaucagccaaaaaauaaaguugaugauaaaaaacuccaacguaaauauguauuuuaucguaacgaaauucgacaagaagcuaauugguuagccagcgaccuuauccauuuuaugaaaaacaaaucgcuauggaaaggauacaugcauaacgaauuacaaucauuuuuagccuuuuuugaagauaaaaaaaaugacuguauagccuuauuagaaacuguuuuuaaccuaaaagaagauuguauuuuaacaaaaggcuuaaaaaauuuauuucucaagcaugguaauuuuauugauuucuacaaagaauauuuaaaauuaaaagaagacuucuugaguacugaaucuacuuuuuuagaaaacggguuuauuggguuaccaccuaaaauuuuaaaaaaagaauuaucaaaaaggcucaaauauauauucauuguauuucaaaaacgccaauuuauaauuaaagaauuagaagaaaagaaaaacaauuuauaugcugaugccaucaauuuaucccgugguauauuugacgagaaaccuacaaugauuccguuuaaaaaaccaaauccagaugaguuugcuucuugguuugucgcaucuuaucaauacaacaauuaucaaucuuuuuaugaauugacaccagacauuguagagagagauaaaaagaaaaaauacaaaaaccuacgagcgauuaacaaaguaaaaauucaagacuauuauuuaaaauuaaugguagauacuuuguaucaagacuuguucaaucagccauuagacaaaucuuuaucagauuuuuauguuucuaaagcagaaagagaaaaaauaaaagccgaugccaaagcuuaccaaaagcucaacgauagcuccuuauggaauaaagucauccauuuaucuuuacaaaauaauaggauuaccgcuaauccgaaacuaaaagacauaggaaaauacaagagagcccugcaagaugaaaaaauagccacgcugcuuacuuaugaugcuagaacguggacguaugccuuacaaaaaccugagaaggaaaaugaaaacgauuauaaagaauugcacuauaccgcacuuaauauggaauugcaagaguaugaaaaagugcguaguaaagaacuacuaaaacaaguacaagaauuagagaaaaaaauuuuagauaaauuuuaugauuuuucuaauaaugcuagucauccugaagauuuagaaauugaggauaaaaaaggaaaaagacacccuaauuuuaaacuuuacauuacaaaagccuuauuaaaaaaugaaucugaaaucauaaauuuagaaaacauagauauugaaauuuuacuuaaauauuaugauuauaauacugaagaguugaaggaaaaaauaaaaaauauggaugaggaugaaaaagccaaaauaauuaauacuaaagagaauuauaacaaaauaaccaauguuuuaauuaaaaaagcacuuguuuuaauuaucauucgcaacaaaauggcgcacaaucaauauccaccuaaauuuauuuacgauuuagcgaaucguuuugucccaaaaaaagaagaagaauacuuugcgaccuauuucaaccgaguuuuugaaaccauaacaaaagaauuaugggaaaacaaagagaaaaaagauaaaacacaggucuaa

SEQ ID NO: 11062 - RNA, 3468 nt, Artificial Sequence
  Cas13b variant__Flavobacterium sp.__WP_045968377.1__Cas13b
auggauaacaauauuacuguagaaaaaacagaauuagguuuagguaucaccuauaaucaugauaaaguugaagacaaacauuauuucggugguuucuuuaacuuggcucaaaacaacauugauuuaguugcucaagaauuuaaaaaaagacuuuuaauacaaggaaaagauaguauaaacauauuugcuaauuauuuuucugaccaaugcucaauuacuaaucuagaaagaggaauuaaaauauuagcugaauauuuuccagugguuucuuacauugacuuagaugaaaaaaauaaaaguaaaaguauuagggagcaucuaauuuuguuauuagagacaaucaauaaucuaagaaauuauuacacucauuauuaucacaaaaaaauaauaauugaugguucuuuauuuccacuacucgauacuauacuuuuaaaaguaguuuuagaaauaaaaaagaagaaauuaaaagaagacaaaaccaagcaauuauuaaaaaaaggacuugagaaagaaaugacuauccuuuuuaaucuaaugaaagcugagcaaaaagagaaaaaaauuaaaggauggaacauugacgaaaauauuaaaggugcgguuuugaaucgugcuuuuagucaucuauuauauaaugaugaacuaagugauuauagaaaaucuaaauauaauacugaggaugaaacuuuaaaagacacacuaacugaaagugguaucuuauuuuuauuauccuuuuucuuaaacaagaaagaacaagaacaguuaaaagcaaauauaaaagguuauaaaggaaaaauugcuaguauuccugaugaagagauuacguuaaaaaacaauagucuuagaaauauggcuacacacuggacuuauucacaucuuacuuauaaaggauuaaaacaucgaauaaaaacggaucacgaaaaagaaacacuuuuaguaaacaugguggacuauuuaaguaaaguuccucaugaaauuuaccaaaaccuuucagaacaaaauaaaucuuuauuucuugaagauauaaaugaauauaugagagauaaugaggaaaaccaugauucuucugaagcuucucguguuauucacccaguuauuagaaaaagguaugaaaacaaguuugcuuauuuugcuauucguuuuuuagaugaguuugcagaauuucccacacuacgauuuaugguuaacguagggaauuauauucacgauaaucgaaaaaaagauauuggaggaacuucuuuaauaacuaacagaacaauaaagcaacaaaucaauguuuuuggaaaccuuacagaaauucauaaaaagaaaaaugauuauuuugaaaaagaagaaaacaaagaaaaaacguuagaaugggaauuauuuccaaauccuagcuaucauuuucaaaaagaaaacauuccuauuuuuauagauuuagaaaaaaguaaagaaacuaaugauuuagcuaaagaauaugcaaaagaaaaaaagaaaauauuuggaaguucaagaaagaaacaacaaaauacugcuaaaaaaaauagagaaacaauuaucaaucuuguuuuugacaaauacaaaacgagugaccguaaaacaguaacuuuugaacaacccacugcuuuauuaaguuucaaugaacuaaauucuuuuuuauaugcuuuuuuaguagaaaauaagacugguaaagaacucgaaaaaauaauuauugaaaaaauagcaaaccaauaucaaauucuaaaaaauuguucuucaacugucgauaaaacuaacgacaacauaccaaagucuauuaaaaaaauaguuaauacaacuacagauucauuuuauuucgagggcaaaaaaauugauauugaaaaacuagaaaaagauaucacuauugaaauagaaaaaacaaaugagaaauuagaaacaauaaaagaaaaugaagaaucugcacagaacuauaaaagaaaugaaagaaauacucaaaaaagaaaacuauaucgaaaauauguauuuuucacaaacgaaauaggaauugaagcuacauggauaaccaaugauauucuucguuuuuuagauaauaaagaaaacuggaaaggauaccaacauagugaauuacaaaaauuuauuucacaauaugauaauuauaagaaagaagcucuuggauugcuagaaucagaauggaauuuagagucugacgcuuucuuuggacaaaauuuaaaaagaauguuucaaagcaauuccaccuucgaaacguucuacaaaaaauauuuagauaauagaaaaaauacuuuagaaacuuauuuaagugcaauugaaaaucuaaaaacaaugacagauguacguccuaaaguucuaaagaaaaaguggacagaacuauuucguuuuuuugacaagaaaaucuaucuauuaucuacuauugagacuaaaauaaacgaacuuauuacuaaaccuaucaauuuaucaagagguauauuugaagagaaaccuacuuucauaaaugggaaaaacccaaacaaagaaaauaaccaacaucuguuugcuaacugguuuauuuaugccaaaaaacaaacuauucuucaagauuuuuacaauuuaccuuuagaacagccuaaagcaauuaccaaccuuaaaaaacacaaauacaaauuagaaagaagcauaaacaauuuaaaaauugaagauauuuacaucaaacagaugguugauuuuuuauaucaaaaacuauucgaacaaucuuuuauaggaucuuuacaggaucuuuauacuuccaaagaaaaaagagaaauugaaaaaggcaaagccaaaaacgaacaaacaccugaugaaaguuuuauuuggaaaaaacaaguugaaauuaauacucacaauggaagaaucauugcaaaaacaaaaauaaaagacauuggaaaguuuaaaaaccuuuuaacugacaauaaaauagcacauuuaaucucuuaugaugauagaauaugggauuuuucauuaaacaacgauggugauauuacaaaaaaauuauacagcauaaauaccgaauuagaaaguuaugaaacaauuagaagagaaaagcuacuaaaacaaauacaacaauuugaacaauuucuuuuagagcaagaaacugaguauagugcagaaagaaaacauccugaaaaguuugaaaaagauuguaauccuaauuuuaaaaaauauauaauugaaggaguuuuaaauaaaauuauaccuaaccaugaaauugaagaaaucgaaauuuuaaaaaguaaagaagauguauuuaaaauuaauuuuagugauauacuaauccucaauaaugacaauauaaaaaaaggguauuuacucauuaugauuagaaacaaauuugcacacaaucaauugauugacaaaaacuuauuuaacuuuucuuuacaacuguauucaaaaaaugaaaacgaaaauuuuucagaauauuuaaacaaaguaugccaaaauaucauucaagaguuuaaagaaaaacuaaaguaa

SEQ ID NO: 11063 - RNA, 3480 nt, Artificial Sequence
  Cas13b variant__Myroides odoratimimus__EHO06562.1__Cas13b
augaaagauauacuuacuacagauacaacagaaaagcaaaaccguuuuuauucucauaaaauagcagauaaauacuucuuugggggauauuuuaaucuugcuucuaauaauauuuaugaggucuuugaggagguaaacaagagaaauacuuuugguaaacuagcuaagcgagauaaugguaauuuaaagaauuauauuauucauguuuuuaaagaugaguugaguauuagugauuuugaaaaacguguggcaauauucgcaaguuauuuuccuauuuuagaaacaguggauaagaagaguauuaaggaacgaaauagaaccauagaccuuacucuuucucaacgaauaagacaguuuagagagaugcuuaucucuuuaguaacugcaguugaccaguugcguaauuuuuacacacauuaucaccacagugauauagugauagaaaauaagguauuggacuucuuaaauaguucauucgugucaacagcgcuccaugugaaagauaaauauuuaaaaacagauaaaaccaaagaguuuuuaaaagagacuauugcagcugaacuagauauucugauugaggcguauaaaaagaagcagauagagaagaagaauacuagguuuaaagcuaauaaaagagaggauauucucaaugcgauauauaaugaggcuuuuuggucauuuauuaaugauaaagauaaagauaaagauaaagagacgguaguagcaaaaggugcggaugcuuauuuugagaagaaccaucauaaaaguaaugauccugacuuugcuuuaaauaucucugagaaagguauuguauaucuguugucuuucuuucugacaaauaaagaaauggauagucuaaaggcaaauuugacaggcuuuaaaggaaagguugauagagaaagugguaauagcauuaaauauauggcuacacagcguaucuauucuuuucauacuuauagaggauuaaaacaaaagauacguacaucagaagaagggguaaaagaaacgcuacugaugcaaaugauagaugagcugaguaaagugccgaauguuguauaucaacauuuaucaacaacucaacaaaauaguuuuauagaggacuggaaugaguauuauaaagacuaugaggaugacguagaaacagaugaucugucaagaguaauucacccagugauucgcaagcgcuaugaagacagguuuaacuauuuugcuauucguuucuuagaugaguuuuuugauuucccuacguugagauuucaaguacauuuaggagauuauguacacgauagaagaacgaaacaguuagggaaaguagaaucagauaggauaaucaaggagaagguaacaguauuugcacgcuuaaaagauauaaauagugcuaaagcgaguuauuuucacucguuagaagagcaggauaaggaggaguuagauaauaaauggacuuuauucccuaacccgaguuaugacuucccuaaagagcauacucuucagcaucaaggugaacaaaagaaugcaggaaagauagguaucuauguaaaacuuagagauacccaauauaaagagaaggcagcuuuagaagaagcuaggaagucauuaaacccuaaagagaggucugcuacuaaggcuaguaaauaugauauuauuacacaaauaauagaagcaaaugauaauguaaaaagcgaaaaaccuuuaguguucacuggucaaccuauugcauaucuaaguaugaaugauauacauucaaugcuuuucucuuuauuaacagauaaugcggaguuaaagaaaacuccugaagagguagaagcaaagcuaauagaccaaauagguaaacagauaaaugagauucuuaguaaagauacugauacuaaaauacuaaaaaaguauaaggacaacgacuuaaaagagacugauacagauaagauaacuagagauuuagcucgugauaaagaggagauagagaagcuaauccuagaacagaaacaaagagcagaugauuauaauuauacaucuaguacaaaauuuaauauugauaaaaguagaaaaaggaaacaccuuuuauuuaaugcugaaaaaggaaagauaggaguaugguuggccaaugauauuaaacgcuuuauguucaaagaaucuaagucuaaauggaagggauaucagcauaccgaacuacagaaacucuuugcuuauuuugauacaaguaaaagugauuuggaguuaauucuuaguaauauggugauggucaaggauuacccuauugaguuaauagauuuaguaaagaagucacgaacauuaguugauuuucugaauaaguauuuagaagcaagguuagaauauauagagaaugucaucacaagaguaaagaauaguauaggaacuccacaguuuaaaacgguucguaaagaauguuuuacuuucuuaaaaaagucuaacuacacuguaguuucuuuagauaaacaaguagaacgcauucuaucuaugccacucuuuauagaacgugguuuuauggaugauaaaccuacgauguuagaaggcaaaagcuauaaacaacauaaggaaaaguucgcagauugguucguacauuauaaagagaauagcaacuaucagaacuucuaugauacagaaguuuaugagauaacaacagaggauaaaagagaaaaggcuaaaguaacgaagaagauaaagcaacagcagaagaaugauguauucacacugaugauggugaauuauauguuagaagaaguauugaaauuaucaucuaacgaccguuuaagcuuaaaugagcucuaucaaacuaaagaggagcguauagugaauaaacaaguagcuaaggauacacaggagcguaauaaaaacuauauuuggaacaaggucguugaucuacaguugugugaugguuuaguccauauugauaaugugaagcuaaaagauauaggcaacuuuagaaaauaugagaaugauagucguguaaaagaguuucuuacuuaucagucagacauagucuggagugcuuauuuaucgaaugagguagauaguaauaagcucuauguaauagagcgucagcuugauaauuaugaaucuauuagaaguaaagagcuguuaaaagagguacaagaaauagaguguagcgucuauaaucaaguagcgaauaaagagucuuuaaaacaaucagguaaugagaacuuuaaacaauauguacuucaggguuuacugccuauagguauggauguaagagagaugcuuauauuaucaacugacgucaaguuuaaaaaagaggagauuauacaguuaggacaagcuggggaaguagagcaagauuuguauagucuaaucuauauccguaauaaguuugcucacaaccaacugccgauuaaggaguucuuugauuucugugaaaauaauuauagaucgauuagugauaaugaauacuaugcugaguauuauauggagauauucagaucuauuaaagagaaauaugcaaacuag

SEQ ID NO: 11064 - RNA, 3474 nt, Artificial Sequence
  Cas13b variant__Myroides odoratimimus__WP_006261414.1__Cas13b
augaaagauauacuuacuacagauacaacagaaaagcaaaaccguuuuuauucucauaaaauagcagauaaauacuucuuugggggauauuuuaaucuugcuucuaauaauauuuaugaggucuuugaggagguaaacaagagaaauacuuuugguaaacuagcuaagcgagauaaugguaauuuaaagaauuauauuauucauguuuuuaaagaugaguugaguauuagugauuuugaaaaacguguggcaauauucgcaaguuauuuuccuauuuuagaaacaguggauaagaagaguauuaaggaacgaaauagaaccauagaccuuacucuuucucaacgaauaagacaguuuagagagaugcuuaucucuuuaguaacugcaguugaccaguugcguaauuuuuacacacauuaucaccacagugagauagugauagaaaauaagguauuggacuucuuaaauaguucauuagugucaacagcgcuccaugugaaagauaaauauuuaaaaacagauaaaaccaaagaguuuuuaaaagagacuauugcagcugaacuagauauucugauugaggcguauaaaaagaagcagauagagaagaagaauacuagguuuaaagcuaauaaaagagaggauauucucaaugcgauauauaaugaggcuuuuuggucauuuauuaaugauaaagauaaagauaaagagacgguaguagcaaaaggugcggaugcuuauuuugagaagaaccaucauaaaaguaaugauccugacuuugcuuuaaauaucucugagaaagguauuguauaucuguugucuuucuuucugacaaauaaagaaauggauagucuaaaggcaaauuugacaggcuuuaaaggaaagguugauagagaaagugguaauagcauuaaauauauggcuacacagcguaucuauucuuuucauacuuauagaggauuaaaacaaaagauacguacaucagaagaagggguaaaagaaacgcuacugaugcaaaugauagaugagcugaguaaagugccgaauguuguauaucaacauuuaucaacaacucaacaaaauaguuuuauagaggacuggaaugaguauuauaaagacuaugaggaugacguagaaacagaugaucugucaagaguaauucacccagugauucgcaagcgcuaugaagacagguuuaacuauuuugcuauucguuucuuagaugaguuuuuugauuucccuacguugagauuucaaguacauuuaggagauuauguacacgauagaagaacgaaacaguuagggaaaguagaaucagauaggauaaucaaggagaagguaacaguauuugcacgcuuaaaagauauaaauagugcuaaagcgaauuauuuucacucguuagaagagcaggauaaggaggaguuagauaauaaauggacuuuauucccuaacccgaguuaugacuucccuaaagagcauacucuucagcaucaaggugaacaaaagaaugcaggaaagauagguaucuauguaaaacuuagagauacccaauauaaagagaaggcagcuuuagaagaagcuaggaagucauuaaacccuaaagagaggucugcuacuaaggcuaguaaauaugauauuauuacacaaauaauagaagcaaaugauaauguaaaaagcgaaaaaccuuuaguguucacuggucaaccuauugcauaucuaaguaugaaugauauacauucaaugcuuuucucuuuauuaacagauaaugcggaguuaaagaaaacuccugaagagguagaagcaaagcuaauagaccaaauagguaaacagauaaaugagauucuuaguaaagauacugauacuaaaauacuaaagaaguauaaggauaacgacuuaaaagagacugauacagauaagauaacuagagauuuagcucgugauaaagaggagauagagaagcuaauccuagaacagaaacaaagagcagaugauuauaauuauacaucuaguacaaaauuuaauauugauaaaaguagaaaaaggaaacaccuuuuauuuaaugcugaaaaaggaaagauaggaguaugguuggccaaugauauuaaacgcuuuaugacagaggaguuuaagucuaaguggaagggauaucagcauacagaacuacagaaacucuuugcuuauuaugauacaaguaaaagugauuuggauuuaauucuuagugauauggugauggucaaggauuacccuauugaguuaauagcuuuaguaaagaagucacgaacauuaguugauuuucugaauaaguauuuagaagcaagguuaggauauauggagaaugucaucacaagaguaaagaauaguauaggaaccccacaguuuaaaacgguucguaaagaauguuuuacuuucuuaaaaaagucuaacuacacuguaguuucuuuagauaaacaaguagaacgcauucuaucuaugccacucuuuauagaacgugguuuuauggaugauaaaccuacgauguuagaaggcaaaagcuaucaacaacauaaggaaaaguucgcagauugguucguacauuauaaagagaauagcaacuaucagaacuucuaugauacagaaguuuaugagauaacaacagaggauaaaagagaaaaggcuaaaguaacgaagaagauaaagcaacagcagaagaaugauguauucacacugaugauggugaauuauauguuagaagaaguauugaaauuaucaucuaacgaccguuuaagcuuaaaugagcucuaucaaacuaaagaggagcguauagugaauaaacaaguagcuaaggauacacaggagcguaauaaaaacuauauuuggaacaaggucguugaccuucaauuaugcgaagguuugguucguauagauaaggugaaacuaaaagauauaggcaacuuuagaaaauaugagaaugauagucguguaaaagaguuucuuacuuaucagucagacauagucuggagugcuuauuuaucgaaugagguagauaguaauaagcucuauguaauagagcgucagcuugauaauuaugaaucuauuagaaguaaagagcuguuaaaagagguacaagaaauagaguguagcgucuauaaucaaguagcgaauaaagagucuuuaaaacaaucagguaaugagaacuuuaaacaauauguacuucaggguuuagugccuauagguauggauguaagagagaugcuuauauuaucaacugacguuaaguuuauaaaagaggagauuauacaguuaggacaagcuggggaaguagagcaagauuuguauagucuaaucuauauccguaauaaguuugcucacaaccaacugccgauuaaggaguucuuugauuucugugaaaauaauuauagaucgauuagugauaaugaauacuaugcugaguauuauauggagauauucagaucuauuaaagagaaauauacaaguuag

SEQ ID NO: 11065 - RNA, 3474 nt, Artificial Sequence
  Cas13b variant__Myroides odoratimimus__EKB06014.1__Cas13b
augaaagauauacuuacuacagauacaacagaaaagcaaaaccguuuuuauucucauaaaauagcagauaaauacuucuuugggggauauuuuaaucuugcuucuaauaauauuuaugaggucuuugaggagguaaacaagagaaauacuuuugguaaacuagcuaagcgagauaaugguaauuuaaagaauuauauuauucauguuuuuaaagaugaguugaguauuagugauuuugaaaaacguguggcaauauucgcaaguuauuuuccuauuuuagaaacaguggauaagaagaguauuaaggaacgaaauagaaccauagaccuuacucuuucucaacgaauaagacaguuuagagagaugcuuaucucuuuaguaacugcaguugaccaguugcguaauuuuuacacacauuaucaccacagugagauagugauagaaaauaagguauuggacuucuuaaauaguucauuagugucaacagcgcuccaugugaaagauaaauauuuaaaaacagauaaaaccaaagaguuuuuaaaagagacuauugcagcugaacuagauauucugauugaggcguauaaaaagaagcagauagagaagaagaauacuagguuuaaagcuaauaaaagagaggauauucucaaugcgauauauaaugaggcuuuuuggucauuuauuaaugauaaagauaaagauaaagagacgguaguagcaaaaggugcggaugcuuauuuugagaagaaccaucauaaaaguaaugauccugacuuugcuuuaaauaucucugagaaagguauuguauaucuguugucuuucuuucugacaaauaaagaaauggauagucuaaaggcaaauuugacaggcuuuaaaggaaagguugauagagaaagugguaauagcauuaaauauauggcuacacagcguaucuauucuuuucauacuuauagaggauuaaaacaaaagauacguacaucagaagaagggguaaaagaaacgcuacugaugcaaaugauagaugagcugaguaaagugccgaauguuguauaucaacauuuaucaacaacucaacaaaauaguuuuauagaggacuggaaugaguauuauaaagacuaugaggaugacguagaaacagaugaucugucaagaguaauucacccagugauucgcaagcgcuaugaagacagguuuaacuauuuugcuauucguuucuuagaugaguuuuuugauuucccuacguugagauuucaaguacauuuaggagauuauguacacgauagaagaacgaaacaguuagggaaaguagaaucagauaggauaaucaaggagaagguaacaguauuugcacgcuuaaaagauauaaauagugcuaaagcgaguuauuuucacucguuagaagagcaggauaaggaggaguuagauaauaaauggacuuuauucccuaacccgaguuaugacuucccuaaagagcauacucuucagcaucaaggugaacaaaagaaugcaggaaagauagguaucuauguaaaacuuagagauacccaauauaaagagaaggcagcuuuagaagaagcuaggaagucauuaaacccuaaagagaggucugcuacuaaggcuaguaaauaugauauuauuacacaaauaauagaagcaaaugauaauguaaaaagcgaaaaaccuuuaguguucacuggucaaccuauugcauaucuaaguaugaaugauauucauucaaugcuuuucucuuuauuaacagauaaugcggaguuaaagaaaacuccugaagagguagaagcaaagcuaauagaccaaauagguaaacagauaaaugagauucuuaguaaagauacugauacuaaaauacuaaagaaguauaaggauaacgacuuaaaagagacugauacagauaagauaacuagagauuuagcucgugauaaagaggagauagagaagcuaauccuagaacagaaacaaagagcagaugauuauaauuauacaucuaguacaaaauuuaauauugauaaaaguagaaaaaggaaacaccuuuuauuuaaugcugaaaaaggaaagauaggaguaugguuagccaaugauauuaaacgcuuuauguucaaagaaucuaagucuaaauggaagggauaucaacauacagaacuacagaaacucuuugcuuauuuugauacaaguaaaagugauuuggaguuaauucuaagugauauggugauggucaaggacuauccaauagaguuaauagauuuaguucggaagucaagaacauuaguugauuuucugaauaaguauuuagaagcaagguuaggauauauagagaaugucaucacaagaguaaagaauaguauagggacaccacaguuuaaaacgguucguaaagaguguuuugcuuucuuaaaagagucuaacuacacuguagcuucuuuagauaaacagauagagcgcauccuaucuaugccucucuuuauagaacgugguuuuauggauagcaaaccuacgauguuagaaggcaaaagcuaucaacagcauaaggaagacuuugcugauugguucguacauuauaaagagaauagcaacuaucagaacuucuaugauacagaaguuuaugagauaauaacagaggauaaaagagaacaagcuaaaguaacgaagaaaauaaagcaacagcagaagaaugauguauucacacugaugauggugaauuauaugcuagaagaaguauugaaauuaccaucuaacgaucguuuaagcuuaaaugagcucuaucaaacuaaagaggagcguauagugaauaaacaaguagcuaaggauacgcaggagcguaauaaaaacuauauuuggaacaaggucguugaccuucaauuaugcgaagguuugguucguauagauaaggugaaacuaaaagauauaggcaacuuuagaaaauaugagaaugauagucguguaaaagaguuucuuacuuaucagucagacauagucuggagugguuauuuaucgaaugagguagauaguaauaagcucuauguaauagagcgucagcuugauaauuaugaaucuauuagaaguaaagagcuguuaaaagagguacaagaaauagagugcaucgucuauaaucaaguagcaaauaaggagucuuuaaaacaaucagguaaugagaacuuuaaacaauauguacuucagggguuacugccucgagguacggauguaagagagaugcuuauauuaucaacugacgucaaguuuaaaaaagaggagauuaugcaguuaggacaaguuagggaaguagaacaagauuuguauagucuaaucuauauccgcaauaaguuugcgcauaaucaacugccgauuaaggaguucuuugauuucugugaaaauaauuauagaccgauuagugauaaugaauacuaugcugaguauuauauggagauauucagaucuauuaaagagaaauaugcaagcuag

SEQ ID NO: 11066 - RNA, 3480 nt, Artificial Sequence
  Cas13b variant__Myroides odoratimimus__WP_058700060.1__Cas13b
augaaagauauacuuacuacagauacaacagaaaagcaaaaccguuuuuauucucauaaaauagcagauaaauacuucuuugggggauauuuuaaucuugcuucuaauaauauuuaugaggucuuugaggagguaaacaagagaaauacuuuugguaaacuagcuaagcgagauaaugguaauuuaaagaauuauauuauucauguuuuuaaagaugaguugaguauuagugauuuugaaaaacguguggcaauauucgcaaguuauuuuccuauuuuagaaacaguggauaagaagaguauuaaggaacgaaauagaaccauagaccuuacucuuucucaacgaauaagacaguuuagagagaugcuuaucucuuuaguaacugcaguugaccaguugcguaauuuuuacacacauuaucaccacagugauauagugauagaaaauaagguauuggacuucuuaaauaguucauucgugucaacagcgcuccaugugaaagauaaauauuuaaaaacagauaaaaccaaagaguuuuuaaaagagacuauugcagcugaacuagauauucugauugaggcguauaaaaagaagcagauagagaagaagaauacuagguuuaaagcuaauaaaagagaggauauucucaaugcgauauauaaugaggcuuuuuggucauuuauuaaugauaaagauaaagauaaagauaaagagacgguaguagcaaaaggugcggaugcuuauuuugagaagaaccaucauaaaaguaaugauccugacuuugcuuuaaauaucucugagaaagguauuguauaucuguugucuuucuuucugacaaauaaagaaauggauagucuaaaggcaaauuugacaggcuuuaaaggaaagguugauagagaaagugguaauagcauuaaauauauggcuacacagcguaucuauucuuuucauacuuauagaggauuaaaacaaaagauacguacaucagaagaagggguaaaagaaacgcuacugaugcaaaugauagaugagcugaguaaagugccgaauguuguauaucaacauuuaucaacaacucaacaaaauaguuuuauagaggacuggaaugaguauuauaaagacuaugaggaugacguagaaacagaugaucugucaagaguaacucacccagugauucgcaagcgcuaugaagacagguuuaacuauuuugcuauucguuucuuagaugaguuuuuugauuucccuacguugagauuucaaguacauuuaggagauuauguacacgauagaagaacgaaacaguuagggaaaguagaaucagauaggauaaucaaggagaagguaacaguauuugcacgcuuaaaagauauaaauagugcuaaagcgaguuauuuucacucguuagaagagcaggauaaggaggaguuagauaauaaauggacuuuauucccuaacccgaguuaugacuucccuaaagagcauacucuucagcaucaaggugaacaaaagaaugcaggaaagauagguaucuauguaaaacuuagagauacccaauauaaagagaaggcagcuuuagaagaagcuaggaagucauuaaacccuaaagagaggucugcuacuaaggcuaguaaauaugauauuauuacacaaauaauagaagcaaaugauaauguaaaaagcgaaaaaccuuuaguguucacuggucaaccuauugcauaucuaaguaugaaugauauacauucaaugcuuuucucuuuauuaacagauaaugcggaguuaaagaaaacuccugaagagguagaagcaaagcuaauagaccaaauagguaaacagauaaaugagauucuuaguaaagauacugauacuaaaauacuaaaaaaguauaaggacaacgacuuaaaagagacugauacagauaagauaacuagagauuuagcucgugauaaagaggagauagagaagcuaauccuagaacagaaacaaagagcagaugauuauaauuauacaucuaguacaaaauuuaauauugauaaaaguagaaaaaggaaacaccuuuuauuuaaugcugaaaaaggaaagauaggaguaugguuggccaaugauauuaaacgcuuuauguucaaagaaucuaagucuaaauggaagggauaucagcauaucgaacuacagaaacucuuugcuuauuuugauacaaguaaaagugauuuggaguuaauucuuaguaauauggugauggucaaggauuacccuauugaguuaauagauuuaguaaagaagucacgaacauuaguugauuuucugaauaaguauuuagaagcaagguuagaauauauagagaaugucaucacaagaguaaagaauaguauaggaacuccacaguuuaaaacgguucguaaagaauguuuuacuuucuuaaaaaagucuaacuacacuguaguuucuuuagauaaacaaguagaacgcauucuaucuaugccacucuuuauagaacgugguuuuauggaugauaaaccuacgauguuagaaggcaaaagcuauaaacaacauaaggaaaaguucgcagauugguucguacauuauaaagagaauagcaacuaucagaacuucuaugauacagaaguuuaugagauaacaacagaggauaaaagagaaaaggcuaaaguaacgaagaagauaaagcaacagcagaagaaugauguauucacacugaugauggugaauuauauguuagaagaaguauugaaauuaucaucuaacgaccguuuaagcuuaaaugagcucuaucaaacuaaagaggagcguauagugaauaaacaaguagcuaaggauacacaggagcguaauaaaaacuauauuuggaacaaggucguugaucuacaguugugugaugguuuaguccauauugauaaugugaagcuaaaagauauaggcaacuuuagaaaauaugagaaugauagucguguaaaagaguuucuuacuuaucagucagacauagucuggagugcuuauuuaucgaaugagguagauaguaauaagcucuauguaauagagcgucagcuugauaauuaugaaucuauuagaaguaaagagcuguuaaaagagguacaagaaauagaguguagcgucuauaaucaaguagcgaauaaagagucuuuaaaacaaucagguaaugagaacuuuaaacaauauguacuucaggguuuacugccuauagguauggauguaagagagaugcuuauauuaucaacugacgucaaguuuaaaaaagaggagauuauacaguuaggacaagcuggggaaguagagcaagauuuguauagucuaaucuauauccguaauaaguuugcucacaaccaacugccgauuaaggaguucuuugauuucugugaaaauaauuauagaucgauuagugauaaugaauacuaugcugaguauuauauggagauauucagaucuauuaaagagaaauaugcaaacuag

SEQ ID NO: 11067 - RNA, 3465 nt, Artificial Sequence
  Cas13b variant__Paludibacter propionicigenes__WP_013446107.1__Cas13b
augaaaacaucugcaaacaacauuuauuucaauggaaucaauucuuuuaaaaagauuuucgacuccaagggagcuauugcaccaauagcagaaaagucaugucgcaacuucgacaucaaagcacaaaacgauguaaacaaagaacaacguauucauuauuuugccguugggcauacauuuaaacaacuggauaccgagaaucuguuugaauacguccucgaugaaaauuuacgagcaaaaagaccaacacguuuuauaagccuacaacaguuugauaaagaauuuauagaaaauauuaaacguuuaauaucggacauccgcaauaucaauagucacuauauccaucguuucgacccuuuaaagauugaugcuguucccaccaacauaaucgauuuucugaaagagagcuuugagcuggcuguaauacaaaucuaccugaaagaaaaaggaauaaacuaucuucaauuuagugagaacccacaugccgaucaaaaacugguugcguuucugcacgacaaguuuuugccucuggacgaaaagaagacuucaaugcuucagaaugaaaccccucaauuaaaagaauacaaggaauaccgaaaguauuuuaaaacauuaucgaaacaagcugcuauagaccaacuucuguuugcagaaaaagagaccgacuauaucuggaaucuauuugauagucauccgguacucacuauaagugcugguaaauaccuaucuuuuuauucaugcuuguuuuugcuuuccauguuuuuauacaagagcgaagcaaaccagcuuauauccaagauaaaaggguuuaaaaagaauacaaccgaagaggagaaaaguaagcgggagauauuuacuuuuuucuccaaaagauucaacagcauggauauugauagcgaagaaaaucaacugguaaaguucagggauuugauauuauaucugaaucauuauccgguggcauggaauaaagaccuugaacuggauucgucgaacccugccaugaccgacaagcucaagaguaaaauuauugaacuggaaauaaaucguucauuuccuuuauacgaaggaaaugagcgguucgccacauuugccaaauaucagauuugggguaagaagcaucugggcaaguccaucgaaaaagaauauauaaaugcaagcuuuaccgacgaagaaauaacugcuuauacguacgaaacagacaccugccccgaguugaaagaugcucauaaaaaauuggcugacuuaaaagccgcaaaggggcuauucgggaagagaaaggagaaaaacgaaagugauauuaaaaaaacggaaacgagcauuagggaauuacaacaugagccaaauccgauaaaagacaaguugauucagcguauugaaaagaaccugcucaccguuucuuauggacgaaaccaggaucgguuuauggacuuuucagcgcgcuuuuuggcugaaaucaauuacuucgggcaagaugccucguuuaaaauguaucauuuuuacgcuaccgaugagcaaaacagcgaacuugaaaaauaugaacuacccaaagauaaaaagaaauacgacagccugaaauuucaucaagggaagcuuguccacuuuaucagcuauaaagaacaucuuaaacguuacgaaucgugggaugacgcuuuuguuaucgagaauaaugccauucagcuuaaacuuucguuugauggaguugaaaacacaguuaccauucagcgggcauuauugauuuauuuguuggaagaugcacucagaaacauucaaaacaauacggcugaaaaugcaggaaaacaacuauuacaagaauauuacucgcacaacaaagccgaccucagcgcauucaaacaaauucugacacaacaagacagcauugagccacaacaaaaaacagaauuuaaaaagcuucuacccagaagacuauuaaauaauuauucaccagcaauaaaucauuuacaaaccccacauucaucacuaccucucauacuugaaaaggcuuuacuggcagaaaaacgauacugcucacugguagugaaagcaaaagcugaaggcaauuacgaugauuucauaaagcggaacaaaggcaaacaauuuaagcuccaguuuauacgaaaagccuggaauuugauguauuuuagaaacagcuauuugcagaacguacaggcagcagggcaccacaaaagcuuucacauugagcgcgaugaguucaaugauuucucgcgauauauguuugccuucgaagagcuaagucaauacaaauacuacuuaaacgagauguuugaaaagaaaggauucuuugagaauaaugaguuuaagauacuguuccaaagcggaacuucguuggaaaaccuauacgaaaaaacuaaacaaaaguuugaaauauggcucgcaaguaauaccgcaaagacgaauaagccugacaacuaucaccugaauaacuaugaacaacaguucagcaaccaacuguuuuucaucaaccuuucgcauuucaucaauuauuugaaaucaacaggcaaacuacaaacugaugcuaacgggcaaauaauauacgaggcuuuaaacaacguucaauaccuuauuccggaguauuacuauaccgacaaaccagagcgcagcgaaucuaaaagcggaaauaagcuuuacaauaaauuaaaagccaccaaacuggaagaugcauugcuuuacgaaauggcuaugugcuaucugaaagcagacaaacagauugccgacaaagcaaaacaccccaucaccaaacugcuaacaagcgauguggaguuuaauaucaccaacaaagaaggaauccagcucuaucauuuauuggugccauuuaaaaaaaucgaugccuuuaucggcuuaaaaaugcacaaagaacaacaagacaaaaaacacccaacuaguuuucuugccaauauugucaacuaccuggaauugguaaagaaugacaaagacaucagaaaaaccuaugaagccuuuaguacgaauccugugaagaggacauuaaccuacgacgaucuggcgaagauagacggucacuugauuuccaaaucuaucaaguucaccaauguaacauuggaguuggaacgcuauuuuauuuuuaaagaaucauuaaucgucaaaaagggcaacaauauugauuucaaguauaucaaaggcuuaagaaauuauuacaacaaugaaaagaaaaagaacgaaggaaucagaaauaaggcauuccauuucgguauccccgauucgaagaguuaugaccaacugauacgugaugcugaaguuauguuuauagccaacgaggugaaaccgacucaugccacaaaauauaccgaucugaacaaacaauuacacaccguaugcgauaaauugauggagacaguucacaacgauuauuuuagcaaagaaggugauggaaaaaagaaacgugaagcugccgggcaaaaguauuuugaaaauauaaucucugcuaaguaa

SEQ ID NO: 11068 - RNA, 3396 nt, Artificial Sequence
  Cas13b variant__Phaeodactylibacter xiamenensis__WP_044218239.1__Cas13b
augacaaauacgccgaaacgccgaacgcuucacagacacccauccuacuuuggggccuuucugaauaucgcacgucacaaugcauuuaugaucauggagcauuugucuaccaaauaugauauggaggacaaaaacacccuggaugaagcucagcucccaaaugccaaacuauuuggcugccugaagaaaagauauggcaagccagauguuacagaaggugucucgcgcgacuuaagaagauacuucccauuccuuaauuacccucuauuccuacaccuagaaaagcagcaaaacgcggaacaggcugcuaccuaugacaucaauccugaagauauagaguuuacgcuuaaaggcuuuuucagguugcucaaccaaaugcguaacaacuacucgcauuacauuucuaacacagacuacgguaaguuugacaagcuccccguacaagauauuuacgaagccgcuauuuucaggcuccucgauaggggaaaacacacuaaaagguuugacgucuuugaaaguaagcauacaaggcaccuugaaagcaacaauagugaguauaggcccagaagccuugcaaacucuccagaucaugaaaacacgguugcuuuugucaccugucucuuccuggaacgcaaauacgccuuuccuuuucugagcagacuggauuguuuuagaaguacuaaugaugcagcagaaggagauccccuaauccggaaagcaagccaugagugcuauacuauguuuuguugccggcuuccacaaccgaaacuggaaagcagugauauucugcuagacauggucaaugaacuugggcggugcccgagugcuuuguacaacuuguugucagaagaagaucaagcacgcuuucacaucaagcgagaggagauaaccgguuuugaagaagacccugacgaagagcucgaacaagagauuguauuaaaacggcacagugaccguuucccuuacuuugcacuucgcuauuuugaugauacagaggcuuuucaaaccuuacgguuugauguauaccugggcagguggaggaccaaaccgguuuauaagaaacggaucuauggucaagagcgggauagagugcuuacccaaucuauccgaaccuuuacaagacuaagccggcuucuuccuaucuacgaaaacguaaagcaugaugcuguccgacagaaugaagaggauggcaaauugguaaaccccgauguaacaucccaguuucacaaaagcuggauccaaauagaaagugaugaucgugcuuuccucucagacagaauugagcacuuuucgccucauuauaauuucggagaucaggucaucgguuugaaguuuaucaauccugaucgguaugccgcuauucaaaauguauuuccaaagcuaccaggagaggagaagaaagauaaagaugcaaaacucguuaaugaaacagcagaugcaauaauuagcacccaugagauccguagcuuguuuuuauaccacuaccuaaguaaaaagccuauuucagcaggggacgagagaagguuuauucagguagauacggagacuuuuauaaagcaguauauagauacgaucaaacuguuuuuugaagauaucaaaucaggcgaacuacaaccuauugccgauccgcccaacuaccaaaagaaugaacccuuacccuaugugcgcggagauaaagagaagacccaggaagagcgggcucaguaucgagagcggcagaaggaaauuaaagaaagaaggaaagaacuuaauacgcugcuucagaauagguauggccugucuauucaguacauucccagccggcuuagagaauacuuguuggguuauaaaaagguccccuaugaaaagcuagcgcuucagaaacuuagagcgcagcguaaggaagucaaaaagaggaucaaggauaucgaaaaaaugcgcacccccagaguaggugaacaggcaaccuggcucgcagaggauaucguuuuuuugacuccgccaaagaugcacacgccugaaaggaaaacuaccaaacacccacagaagcucaauaaugaucaguuccggaucaugcaaucuucccuggcguacuuuuccguaaauaagaaagcaauuaaaaaguucuuucagaaggagacggggaucggucugucaaauagagaaacaagccauccguuucuguauaggaucgacguugggaggugcagggguauuuuagacuucuacacgggcuaccugaaauacaaaauggacuggcuagaugaugcaaucaaaaaaguugauaaucguaaacauggcaagaaggaggcuaaaaaguaugaaaaauaucuacccucauccauucagcauaagacuccucuugaauuagacuacacccgccugccuguuuaucuaccaagaggcuuauuuaaaaaggcaauugucaaagcguuagcugcacaugccgauuuccaggucgaaccagaggaagacaauguaauuuucugucuggaccagcucuuggauggcgauacccaagauuucuauaauuggcaacgguacuaucgcucugcgcuaacggaaaaagaaacugauaaccagcuuguccucgcccaucccuacgcagagcaaauauuagguacaauuaagacacuggaagguaagcagaagaacaauaagcuugggaacaaggcgaaacaaaaaaucaaggaugaacuuauagaucuaaaaagagcaaaacggagguuacuagaccgggaacaauaccuacgggcuguacaagccgaagaucgugcacuauggcuaaugauacaagagcggcaaaagcagaaagcugaacaugaggaaaucgccuuugaucagcucgaccuuaaaaacaucacuaaaauccuaacagagucuauugaugcccgacucagaauaccggauaccaaaguagauauuacggauaagcuuccgcuccguagauauggagaucugcgccguguagcuaaagaucgcagacuggucaaucucgccucuuacuaccauguugcagguuuauccgaaauccccuaugaucuugugaagaaagaacuggaagaguacgaucgccguagaguggccuuuuuugagcacguuuaucaguuugaaaaagaaguauaugaccgcuaugccgcagaacuuagaaacgaaaauccgaaaggugagaguacuuacuucagucauugggaguacguagcuguugcgguaaagcacucugcugauacucauuuuaaugaacucuucaaagagaaaguuaugcaauugcguaacaaguuccaccacaaugaauuccccuauuucgacugguuauugccagagguagaaaaggcgagugccgcucuauacgcggauagagucuuugauguggcagagggcuacuaccagaaaaugcguaaauuaaugcgacaguaa

SEQ ID NO: 11069 - RNA, 3408 nt, Artificial Sequence
  Cas13b variant__Porohyromonas gingivalis__WP_012458151.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauuccuuacuugauuuccugcgcaaugauuucucgcacaaucggcuugauggcacuacauucgagcaucucgaagucagcccugacaucagcuccuuuauuaccgggacauacuccuuggcaugcgggagagcacaaucgcgguuugcaguuuucuucaagcccgacgacuuuguccuggcaaagaacaggaaggaacaauugauaagcguagcggacggaaaagaaugccugaccguuaguggcuuugccuuuuucauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccuggacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucagucgaugggauuuaucagugugcacgaccuucguaagcuucucuugauggaguugcugugugaggggagcuucagccguaugcagagugauuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauauggaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcgccuucuugaccccucuuccgggcauccguuccuuuccgcgaccauggagacagcucaucgguauacggaaggcuucuacaaaugcuaucucgagaagaaacgggaaugguuggcaaaaauuuucuaucggccggaacaggacgagaauacaaaaaggcggauaagcgucuuuuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaaggucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacgggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcugauggccaucaacaagaugaugaccgauagagaagaggauauucugcccggacugaaaaacauagacagcauauuggaugaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgacccugaaaauagauuuuuuggaaagcuuuugaauaauaugucucaaccuaucaaugacuuauaa

SEQ ID NO: 11070 - RNA, 3408 nt, Artificial Sequence
  Cas13b variant__Porohyromonas gingivalis__ERJ81987.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugauuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuuuauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucagucgaugggauuuaucagugugcacgaccuucguaagcuucucuugauggaguugcugugugaggggagcuucagccguaugcagagugguuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauaugaaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcaccuucuugaccccucuuccggacauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacaggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcugauggccaucaacaagaugaugaccgauagagaagaggauauucugcccggacugaaaaacauagacagcauauuggaugaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgaccaugaaaauagauuuuuuggaaagcuuuugaauaauaugucucaaccuaucaaugacuuauaa

SEQ ID NO: 11071 - RNA, 3408 nt, Artificial Sequence
  Cas13b variant__Porohyromonas gingivalis__ERJ65637.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugacuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuucauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucggucgaugggauuuaucagugugcacgaccuucguaagcuucucuugauggaguugcugugugaagggagcuucagccguaugcagagugauuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauauggaucagagacaacugcccucacgucuucuggaugaauggaugaauaucaggccugcaagccauucagucaagcuucguacuuaugucaagcagcucaaugaagacugccgacuacgccugcagaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccaccaauucagggcuaucguggcagaacugcgccuucuugaccccucuuccgggcauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacaggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcugauggccaucaacaagaugaugaccgauagagaagaggauauucugcccggacugaaaaacauagacagcauauuggaugaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgacccugaaaauagauuuuuuggaaagcuuuugaauaauaugucucaaccuaucaaugacuuauaa

SEQ ID NO: 11072 - RNA, 3408 nt, Artificial Sequence
  Cas13b variant__Porohyromonas gingivalis__WP_021665475.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugacuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuuuauuugccucuuccucgauagggagcaggcuuccgguaugcugagcaggauucgcggauucaaacgaaccaaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucagucgaugggauuuaucagugugcacgaccuucguaagcuucucuugauggaguugcugugugaggggagcuucagucguaugcagagugguuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauaugaaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcaccuucuugaccccucuuccggacauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacaggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcuaauggccaucaacaagaugaugaccgauagagaagaggauauucugcccggacugaaaaacauagacagcauauuggauaaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgaccaugaaaauagauuuuuuggaaagcuuuugaauaauaugucucaaccuaucaaugacuuauaa

SEQ ID NO: 11073 - RNA, 3408 nt, Artificial Sequence
  Cas13b variant__Porohyromonas gingivalis__WP_061156637.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugauuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuuuauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucagucgaugggauuuaucagugugcacgaccuucguaagcuucucuugauggaguugcugugugaggggagcuucagccguaugcagagugguuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauaugaaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcaccuucuugaccccucuuccggacauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacaggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcuaauggccaucaacaagaugaugaccgauagagaagaggauauucugcccggacugaaaaacauagacagcauauuggauaaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgacccugaaaauagauuuuuuggaaagcuuuugaauaauaugucucaaccuaucaaugacuuauaa

SEQ ID NO: 11074 - RNA, 3408 nt, Artificial Sequence
  Cas13b variant__Porohyromonas gingivalis__WP_023846767.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugauuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuuuauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucggucgaugggauuuaucagugugcacgaccuucguaagcuucucuugauggaguugcugugugaagggagcuucagccguaugcagagugauuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauaugaaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcaccuucuugaccccucuuccggacauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacaggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcugauggccaucaacaagaugaugaccgauagagaagaggauauucugcccggacugaaaaacauagacagcauauuggaugaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagaguggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgacccugaaaauagauuuuuuggaaagcuuuugaauaauaugucucaaccuaucaaugacuuauaa

SEQ ID NO: 11075 - RNA, 3408 nt, Artificial Sequence
  Cas13b variant__Porohyromonas gingivalis__ERJ87335.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugacuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuucauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucggucgaugggauuuaucagugugcacgaccuucguaagcuucucuugauggaguugcugugugaagggagcuucagccguaugcagagugauuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauauggaucagagacaacugcccucacgucuucuggaugaauggaugaauaucaggccugcaagccauucagucaagcuucguacuuaugucaagcagcucaaugaagacugccgacuacgccugcagaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccaccaauucagggcuaucguggcagaacugcgccuucuugaccccucuuccgggcauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaaggucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacgggacaaaaagcgagaacugcgaacugccgguaagccugucccuccugacuuggcugccuacaucaagcggagcuuucaccgagcugucaaugaacgugaauuuaugcuccgccucgugcaagaagacgaucggcuuaugcugauggccaucaacaagauaaugaccgauagagaagaggauauucugcccggacugaaaaacauagacagcauauuggauaaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagaguggagagcauucuacacuggugaagaugcugguggagaagaaaggcugucugacuccugacgaaagccaauaccugauucugauucgcaacaaggcugcucacaaccaauuucccugcgcugcagaaauaccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgacccugaaaauagauuuuuuggaaagcuuuugaauaauaugucucaaccuaucaaugacuuauaa

SEQ ID NO: 11076 - RNA, 3408 nt, Artificial Sequence
  Cas13b variant__Porohyromonas gingivalis__WP_005873511.1__Cas13b
augaauacaguuccugcuucugaaaacaaaggucaaucccguacaguggaagacgauccgcaguacuucggacuuuaucucaaccucgcacgagagaauuugauagaagucgaaagucauguucgcauuaaguucgggaagaagaaauugaaugaagagucgcucaagcaaucucuucuuugugaucaccugcucuccgucgaucgcuggaccaaagucuauggccauagcagacgcuaucugccuuuccuccauuauuucgauccggauagucagaucgaaaaagaccaugauagcaagaccgguguggaucccgauucggcccaaaggcugaucagagagcuuuauucuuuacuugauuuccugcgcaaugacuucucgcacaaucggcuugauggcacuacauucgagcaucucgaagucagcccugacaucagcuccuuuauuaccgggacauacuccuuggcaugcgggagagcacaaucgcgguuugcagauuucuucaagcccgacgacuuuguccuggcaaagaacaggaaggaacaauugauaagcguagcggacggaaaagaaugccugaccguuaguggccuugccuuuuucauuugccucuuccucgauagggagcaggcuuccgguaugcugagcaggauucgcggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucagucgaugggauuuaucagugugcacaaccuucguaagcuucucuugauggaguugcugugugaggggagcuucagccguaugcagagugauuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauaugaaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcaccuucuugaccccucuuccggacauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacaggacaaaaagcgagaacugcgaacugccgguaagccugucccuccugacuuggcugccgacaucaagcggagcuuucaccgagcugucaaugaacgugaauuuaugcuccgccucgugcaagaagacgaucggcuuaugcugauggccaucaacaagaugaugaccgauagagaagaggauauucugcccggacugaaaaacauagacagcauauuggaugaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgacccugaaaauagauuuuuuggaaagcuuuugaauaauaugucucaaccuaucaaugacuuauaa

SEQ ID NO: 11077 - RNA, 3408 nt, Artificial Sequence
  Cas13b variant__Porohyromonas gulae__WP_039445055.1__Cas13b
augaauacaguuccugcuacugaaaacaaaggccaaucccguacaguggaagacgauccucaguacuucggacuuuaucucaaccucgcacgagagaauuugauagaagucgaaagucauguucgcauuaaguuugggaagaagaaauugaaugaagagucgcucaagcaaucucuucuuugugaucaccugcucuccaucgaucgauggaccaaagucuauggacauagcagacgcuaucugccuuuccuccauuguuucgauccggauagugggaucgaaaaagaccaugauagcaaaaccgguguggaucccgauucggcccaaaggcugaucagagagcuuuauuccuuacucgauuuccugcgcaaugacuucucgcacaaucggcuugauggcacuacauucgagcaucucaaagucagcccugacaucaguuccuuuaucaccggggcauacacuuuugcaugcgaaagagcacaaucgcgauuugcagauuucuucaagccggacgacuuucuucuggcaaagaacaggaaggaacaauugauaaguguagcggacggaaaagaaugccugacuguuagugguuuugcuuuuuucauuugccucuuccucgauagggagcaggcauccgguaugcugagcaggauucguggauucaaacgaaccgaugagaauugggcacgagccgugcacgagaccuucugcgaucucugcauccgucauccucacgacaggcucgaaagcagcaauacgaaagaagcucucuugcucgauaugcucaacgaacugaaccguugcccccgcauccuuuacgauaugcuccccgaagaggagcgggcgcaguuccucccugcgcuggacgaaaauagcaugaacaaccucucggaaaacagccugaacgaagagagucgauugcuuugggacggcucuucggauugggcagaggcacugaccaagaggauccgccaucaggaucgcuuccccuaucugaugcuucguuuuaucgaggagauggaucugcucaaggguauacgcuuucgugucgauuugggugaaaucgagcuggauucuuacuccaaaaagguaggccggaauggugaguacgaucgcacgauaacggaucaugccuuggcauucggcaagcugucagacuuccagaaugaagaagagguaaguaggaugaucaguggagaggcgucuuaucccguacgcuucucucucuuugcuccccgcuaugccauauacgacaauaagauaggcuauugccauacauccgacccuguauauccuaagaguaagacaggggagaagagggccuugagcaauccucagucgaugggauuuaucagugugcacgaccuucguaagcuucucuugauggaguugcugugugaggggagcuucagccguaugcagagugauuuccucagaaaagcgaaucggauccuggaugaaacggcagagggaaaacuacaguuuucggcauuauucccugagaugcgccaccgauuuaucccuccacagaauccgaagagcaaagaccggagggaaaaggcugaaacgacuuuggagaaauacaagcaggagauaaaggggaggaaagacaagcucaauagccaacugcugucggcauucgauaugaaucagagacaacugcccucacgucuucuggaugaauggaugaauaucaggccugcaagccauucagucaagcuucguacuuaugucaagcagcucaaugaagacugccgacuacgccugcggaaguuucggaaggauggcgaugggaaagcucgugccauaccucucgucggugaaauggcuaccuuccucucucaggacaucguccgcaugaucauaagcgaagagacgaagaagcugaucaccuccgcuuacuacaaugagaugcaacgcucucuggcacaauaugccggagaagagaaucgccgccaauucagggcuaucguggcagaacugcaccuucuugaccccucuuccggacauccguuccuuuccgcgaccauggagacagcucaucgguauacggaagacuucuacaaaugcuaucucgagaagaaacgggaaugguuggcaaaaacuuucuaucggccggaacaggacgagaauacaaaaaggcggauaagcgucuucuucgugccggauggcgaagcacgaaaacuacugccccuccucauccgucggcggaugaaggagcagaacgaccuucaggacuggauccgaaacaagcaagcccaccccauagaucugccaucgcaucucuucgauagcaagaucauggagcuacucaaggucaaagacggaaagaagaaauggaaugaggccuuuaaggacugguggaguaccaaguaccccgaugguaugcagccuuucuauggacugcgcagagagcugaauauccacggcaaaucuguaucuuauauaccgucagacggaaagaaauucgccgauugcuacacgcaucugauggagaagaccguacgggacaaaaagcgagaacugcgaacugccgguaagccugucccuccugacuuggcugccuacaucaagcggagcuuucaccgagcugucaaugaacgugaauuuaugcuccgccucgugcaagaagacgaucggcuuaugcugauggccaucaacaagaugaugaccgauagagaagaggauauucugcccggacugaaaaacauagacagcauauuggaugaggagaaccaauucucgcuggcuguccaugcuaaggucuuggagaaagagggugaagggggugauaauucucuuucucuugugccggcaacgaucgaaaucaagagcaagcguaaggauugguccaaguacauacgcuaccgguacgaucgaaggguacccggacuuaugucccacuuucccgagcacaaagcuacguuggaugaagucaagacuuuguugggcgaauaugaucgcugccgcaucaaaaucuucgauugggcauuugcacucgaaggagccaucaugucugaucgcgacuugaagccguauuugcacgagucgucgagcagggaggguaagagcggagagcauucuacacuggugaagaugcugguggagaagaaaggcugucugacuccugacgaaagccaauaccugauucugauucgcaacaaggcugcucacaaccaauuucccugcgcugcagaaaugccucuuauuuaccgagaugugagugcaaaggucgguagcauugagggaucuucugccaaagaucugccggaagguaguucucugguagauucauuauggaaaaaauacgaaaugauaauucggaaaauucuuccgauucucgaccaugaaaauagauuuuuuggaaagcuuuugaauaauaugucucaaccuaucaaugacuuauaa

SEQ ID NO: 11078 - RNA, 3528 nt, Artificial Sequence
  Cas13b variant__Porphyromonas gingivalis__WP_052912312.1__Cas13b
augacagaacaaaacgagaaaccguacaacgguaccuacuacacgcuggaggacaaacauuucugggcagcuuucuucaaucuggcacgucacaacgccuauauuacccucgcccacaucgacaggcagcucgccuacagcaaggccgauauaaccaacgaugaggauauacucuucuucaagggccaauggaaaaaccucgacaacgaucuggagaggaaagcucggcugagaaguuugauccugaagcauuucuccuuuuuggaaggagccgcauacggcaagaaacucuucgaaagccaaucuuccggaaacaaauccuccaagaagaaagaacucacaaaaaaagaaaaggaagaacugcaagccaacgcgcucuccuuggacaaucugaagagcauccuguucgacuuucugcaaaagcucaaggauuucaggaauuacuacucccacuaucgacaucccgaaucuucggaauugcccuuguucgauggaaacaugcuucagagacuguacaacgucuucgaugugagugugcaacgggugaaaagagaucacgagcacaacgacaaggucgauccucaccgccacuucaaccaccuugucaggaaaggcaagaaagauaaguacggcaauaacgacaaucccuucuucaagcaccauuuugucgauagagaggagaaagucacggaagccggacugcuguuuuucgucucccucuuucuugaaaaaagggaugccaucuggaugcaaaagaagauccgaggcuucaagggcggcaccgaagccuaccagcagaugaccaaugaggucuucugccggagccggaucuccuugccgaagcucaaacuggagagccugcgcacggacgacuggaugcugcucgauaugcugaacgaacugguucgcugccccaaguuguuguacgaucgucuucgcgaagaggauagagcgcguuuccgaguacccgucgauauucuguccgaugaggacgauacggacgguacggaagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaagggcagcuucuuuggccgucgccggagguaggagcaacccgaacgggacgaagcaaauacgcccaagacaaacgguucacggcagaagccuuccugagcguacaugagcugaugcccaugauguucuauuacuuccugcugagagaaaaguauuccgaggaggcaagugccgagaaggugcaaggaagaauaaagagggugauagaggauguguacgcugucuacgaugcuuucgcccgagacgaaaucaauacgcgcgacgaguuggaugccuguuuggcggacaaggguauucggcgaggacaucuccccaggcaaaugaucgccauauugucccaagagcauaaggauauggaggagaaaguccgcaagaaacuucaggaaaugauagcggauacggaucaucgucuggauaugcuggaucggcagaccgaccgaaagaucaggaucggcagaaagaaugccggccugccgaagucgggugucauagccgacuggcugguacgggauaugaugcgcuuucagcccguggcgaaagacacgaguggcaagccucugaacaauagcaaggccaacagcaccgaauaccggaugcuacagcgcgcccucgcccuuuucggcggagagaaagagcgucugacaccguauuuccgccagaugaaucugacgggagggaacaauccccauccuuuccugcacgaaacccggugggagagccauaccaauauccuguccuucuaucgcagcuaucugaaagcaagaaaggcuuuucuccaaagcauaggacgaagcgaucgggaggagaaccaccgcuuccuccugcucaaggaacccaaaaccgaucggcagacauuaguggccggcuggaagagcgaauuucaucugccacgcgggauuuuuaccgaagcggucagagacugccugauagagaugggguacgaugaagucgggucauacaaggaagucggauucauggccaaagccguuccgcuauauuucgagcgggcuuguaaagaucggguacagccuuucuaugacuaccccuucaauguaggcaacagccucaagcccaagaaaggacgcuuccugagcaaagaaaagcgagccgaagagugggagagcgguaaggagcgguuccgagaccuugaggcuuggucgcacagugcugcucgucggauagaggaugcuuuugucggaaucgaguaugcaaguugggaaaauaagaagaaaaucgagcagcuguugcaggaucucucccuuugggaaaccuuugagagcaagcugaaagucaaggcagacaagauaaauauugccaaacugaaaaaggaaauacucgaagccaaagaacaccccuaucacgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgacguccaagagcaggggagccucaaugugcugaaccacgugaagccgaugcgcuugcccguggucguguacagagccgacagccgaggccauguacacaaggaggaggcuccucuggcgacggucuauaucgaagaaagggacaccaagcugcugaagcagggcaauuucaaauccuucgucaaggaucgccggcucaacggccuuuucucuuucgucgauaccggcgcacucgcgauggagcaguacccgaucagcaagcucaggguggaguacgagcuggcuaaguaucagacggcaagggucugugccuucgagcagacgcuggagcuggaagagagccugcugacccgauauccucacuugccggaugagagcuucagagagaugcucgaaagcuggucggauccucucuuggacaaguggccggaucugcaaagggaaguccggcuucugaucgcugugcgcaaugccuucucgcacaaucaguaucccauguacgaugagaccaucuuuucguccauccggaaguacgaccccucuucccucgaugccauagaggaaaggauggggcugaacaucgcgcaccgguugagcgaggaagugaagcuggcaaaagaaaugguagaacgaaucauacaagcauaa

SEQ ID NO: 11079 - RNA, 3360 nt, Artificial Sequence
  Cas13b variant__Porphyromonas gingivalis__WP_053444417.1__Cas13b
augacagaacaaaacgagaaaccguacaacgguaccuacuacacgcuggaggacaaacauuucugggcagcuuuccucaaucuggcacgucacaacgccuauauuacccucgcccacaucgacaggcagcucgccuacagcaaagccgauauaaccaacgaugaggauauacucuucuucaagggccaauggaaaaaccucgacaacgaucuggagaggaaagcucggcugagaaguuugauccugaagcauuucuccuuuuuggaaggagccgcauacggcaagaaacucuucgaaagccaaucuuccggaaacaaauccuccaagaagaaagaacucucgaaaaaagaaaaggaggaacugcaagccaaugcacucuccuuggacaaucugaagagcauccuguucgacuuucugcaaaagcucaaggauuucaggaauuacuacucccacuaucgacaucccgaaucuucggaauugccccuguucgauggaaacaugcuucagagacuauacaacgucuucgaugugagugugcaacgggugaaaagagaucacgagcacaacgacaaggucgauccccaccgccacuucaaccaccuugucaggaaaggcaagaaggauaaguacggcaauaacgacaaucccuucuucaagcaccauuuugucgauagagaggggacggucacggaagccggacugcuguuuuucgucucccucuuucuugagaaaagggaugccaucuggaugcaaaagaagauccgaggcuucaagggcggcaccgaagccuaccagcagaugaccaacgaggucuucugccggagccggaucuccuugccgaagcucaaacuggagagccugcgcacggacgacuggaugcugcucgauaugcugaacgaacugguucgcugucccaagucguuguacgaucgucuucgcgaagaggauagagcgcguuuccgaguacccgucgauauucuguccgaugaggacgauacggacgguacggaagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaagggcagcaucuuuggccgucgccggagguaggagcaacccgaacgggacgaagcaaauacgcccaagacaaacggcucacggcagaagccuuccugagcgugcaugaacugaugcccaugauguucuauuacuuccugcugagagaaaaguauuccgaggagguaagugccgagaaggugcaaggaagaauaaagagggugauagaggauguguacgcugucuacgaugcuuucgcccgagacgaaaucaauacgcgcgacgaguuggaugccuguuuggcggacaaggguauucggcgaggacaucuccccaggcaaaugaucgccauauugucccaagagcauaaggauauggaggagaaaguccgcaagaaacuucaggaaaugauagcggauacggaucaucgucuggauaugcuggaucggcagaccgaccgaaagaucaggaucggccgaaagaaugccggccugccgaagucgggugucguagccgacuggcugguacgggauaugaugcgcuuucagcccguggcgaaagacacgaguggcaagccucugaacaauagcaaggccaacagcaccgaauaccggaugcuacagcgcgcccucgcccuuuucgguggagagaaagagcgucugacaccguauuuccgccagaugaaucugacgggagggaacaauccccauccuuuccugcacgagacccggugggagagccauaccaauauccuguccuucuaucgcagcuaucuggaagcaagaaaggcuuuucuccaaagcauaggacgaagcgaucggguggagaaccaccgcuuccuccugcucaaggaacccaaaaccgaucggcagacauuaguggcaggcuggaagggcgaauuucaucugccacgcggcauuuuuaccgaagcggucagagacugccugauagagaugggguacgaugaagucgggucauacaaggaagucggauucauggccaaagccguuccgcuguauuucgagcgggcuucuaaagaucggguacagccuuucuaugacuaccccuucaauguaggcaacagccucaagcccaagaaaggacgcuuccugagcaaagaaaagcgagccgaagagugggagagcgguaaggagcgguuccgacucgccaaacugaaaaaggaaauacucgaagccaaagaacaccccuaucacgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgacguccaagagcaggggagccucaaugugcugaaccgcgugaagccgaugcgcuugcccguggucguguacagagccgacagccgaggccauguacacaaggagcaggcuccucuggcgacggucuauaucgaagaaagggacaccaagcugcugaagcagggcaauuucaaauccuuugucaaggaucgccggcucaacggccuuuucucuuucgucgauaccggcgcacucgcgauggagcaguacccgaucagcaagcucaggguggaguacgagcuggccaaguaucagacggcaagggucugugccuucgagcagacgcuggagcuggaagagagccugcugacccgauauccucacuugccggauaagaacuucagaaagaugcucgaaagcuggucggauccucucuuggacaaguggccggaucugcacgggaauguccggcuucugaucgcugugcgcaaugccuucucgcacaaucaguaucccauguacgaugagacccucuuuucguccauccggaaguacgaccccucuucccccgaugcaauagaggaaaggauggggcugaacaucgcgcaccgguugagcgaggaagugaagcaggcaaaagaaaugguagaacgaaucauacaagcauaa

SEQ ID NO: 11080 - RNA, 3360 nt, Artificial Sequence
  Cas13b variant__Porphyromonas gingivalis__WP_012458414.1__Cas13b
augacagaacaaaacgagagaccguacaacgguaccuacuacacgcuggaggacaaacauuucugggcagcuuucuucaaucuggcacgucacaacgccuauauuacccucgcccacaucgacaggcagcucgccuacagcaaggccgauauaaccaacgaugaggauauacucuucuucaagggccaauggaaaaaccucgacaacgaucuggagaggaaagcucggcugagaaguuugauccugaagcauuucuccuuuuuggaaggagccgcauacggaaagaaacucuucgaaagccaaucuuccggaaacaaauccuccaagaagaaagaacucacgaaaaaagaaaaggaggaacugcaagccaaugcacucuccuuggacaaucugaagagcauccuguucgacuuucugcaaaagcucaaggauuucaggaauuacuacucccacuaucgacaucccgaaucuucggaauugcccuuguuugauggaaacaugcuucagagacuguacaacgucuucgaugugagugugcaacgggugaaaagagaucacgagcacaacgacaaggucgauccccaccgccacuucaaccaccuugucaggaaaggcaagaaggauagguacggcaauaacgacaaucccuucuucaagcaccauuuugucgauagagaggagaaagucacggaagccggacugcuguuuuucgucucccucuuucuugagaaaagggaugccaucuggaugcaaaagaagauccgaggcuucaagggcggcaccgaaaccuaccagcagaugaccaacgaggucuucugccggagccggaucuccuugccgaagcucaaacuggagagccugcgcacggacgacuggaugcugcucgauaugcugaacgaacugguucgcugucccaagucguuguacgaucgucuucgcgaagaggauagagcgcguuuccgaguacccgucgauauucuguccgaugaggacgauacggacgguacggaagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaaggacagcaucuuuggccgucgccggagguaggagcaacccgaacggggcgaagcaaauacgcccaagacaaacggcucacggcagaagccuuccugagcguacaugagcugaugcccaugauguucuacuacuuccugcugagagaaaaguauuccgaugaggcaagugccgagagggugcaaggaagaaucaagagggugauagaggauguguacgcugucuacgaugcuuucgcccgaggcgaaaucaauacgcgcgacgaguuggaugccuguuuggcggacaaggguauucggcgaggacaucuccccaggcaaaugaucggcauauugucccaagagcauaaggauauggaggagaaaguccgcaagaaacuucaggaaaugauaguggauacggaucaccgucuggauaugcuggaucggcagaccgaccgaaagaucaggaucggcagaaagaaugccggccugcccaagucgggcgucauagccgacuggcugguacgggauaugaugcgcuuucagcccguggcgaaagacacgagcggcaagccucugaacaauagcaaggccaacagcaccgaauaccggaugcuacagcgcgcccucgcccuuuucgguggagagaaagagcgucugacaccguauuuccgccagaugaaucugacgggagggaacaauccccauccuuuccugcacgagacccggugggagagccauaccaauauccuguccuucuaucgcagcuaucugaaagcaagaaaggcuuuucuccaaagcauaggacgaagcgaucggguggagaaccaccgcuuccuccugcucaaggaacccaaaaccgaucggcagacauuaguggcaggcuggaagggcgaauuucaucugccacgcgggauuuuuaccgaagcggucagagacugccugauagagauggggcucgaugaagucgggucauacaaggaagucggauucauggccaaagccguuccgcuguauuucgagcgggcuuguaaagaucggguacagccuuucuaugacuaccccuucaauguaggcaacagccucaagcccaagaaaggacgcuuccugagcaaagaaaagcgugccgaagagugggagagcgguaaggagcgguuccgacucgccaaacugaaaaaggaaauacucgaagccaaagaacaccccuaucucgacuucaagucguggcagaaguucgagcgcgaacugcgccuugucaagaaucaggauauuaucacuuggaugauaugcagggaucucauggaagagaacaagguggagggauuggauaccgguacucucuaccugaaagauauucggaccgacguccaagagcagggaaaccucaauguacugaaccgcgugaagccgaugcgcuugcccguggucguguacagagccgacagccgaggccauguacacaaggagcaggcuccucuggcgacggucuauaucgaagaaagggacaccaagcugcugaagcagggcaauuucaaauccuucgucaaggaucgccggcucaacggccuuuucucuuucgucgauaccggcgcacucgcgauggagcaguacccgaucagcaagcucaggguggaguacgagcuggccaaguaucagacggcaagggucugugccuucgagcagacgcuggagcuggaagagagccugcugacccgauauccucacuugccggauaagaacuucagaaagaugcucgaaagcuggucggauccucucuuggacaaguggccggaucugcacgggaauguccggcuucugaucgcugugcgcaaugccuucucgcacaaucaguaucccauguacgacgaggccgucuuuucgucuauucggaaguacgaccccucuucccccgaugccauagaggaaaggauggggcugaacaucgcgcaccgguugagcgaggaagugaagcaggcaaaagaaauggcagaacgaaucauacaagcauaa

SEQ ID NO: 11081 - RNA, 3360 nt, Artificial Sequence
  Cas13b variant__Porphyromonas gingivalis__WP_039417390.1__Cas13b
augacagaacaaaacgagagaccguacaacgguaccuacuacacgcuggaggacaaacauuucugggcagcuuucuucaaucuggcacgucacaacgccuauauuacccucgcccacaucgacaggcagcucgccuacagcaaggccgauauaaccaacgaugaggauauacucuucuucaagggccaauggaaaaaccucgacaacgaucuggagaggaaagcucggcugagaaguuugauccugaagcauuucuccuuuuuggaaggagccgcauacggcaagaaacucuucgaaagccaaucuuccggaaacaaauccuccaagaagaaagaacucacgaaaaaagaaaaggaggaacugcaagccaaugcacucuccuuggacaaucugaagagcauccuguucgacuuucugcaaaagcucaaggauuucaggaauuacuacucccacuaucgacaucccgaaucuucggaauugcccuuguucgauggaaacaugcuucagagacuguacaacgucuucgaugugagugugcaacgggugaaaagagaucacgagcacaacgacaaggucgauccccaccgccacuucaaccaccuugucaggaaaggcaagaaggacagguacggcaauaacgacaaucccuucuucaagcaccauuuugucgauagagaggggacggucacggaagccggacugcuguuuuucgucucccucuuucuugaaaaaagggaugccaucuggaugcaaaagaagauccgaggcuucaagggcggcaccgaagccuaccagcagaugaccaacgaggucuucugccggagccggaucuccuugccgaagcucaaacuggagagccugcgcacggacgacuggaugcugcucgauaugcugaacgaacugguucgcugucccaagucguuguacgaucgucuucgagaagaggauagagcgcguuuccgaguacccaucgauauucuguccgaugaagacgauacggacgguacggaagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaaggacagcaucuuuggccgucgccggagguaggagcaacccgaacgggacgaagcaaauacgcccaagacaaacggcucacggcagaagccuuccugagcgugcaugagcugaugcccaugauguucuacuacuuccugcugagggagaaguauuccgaggagguaagugccgagaaggugcaaggaagaaucaagagggugauagaggauguguacgcugucuacgaugcuuucgcccgaggcgaaauugauacgcuugaccggcuggaugccuguuuggcggacaaggguauucggcgaggacaucucccccggcaaaugaucgccauauugucccaagagcauaaggauauggaggagaaaguccgcaagaaacuucaggaaaugauagcggauacggaucaccgucuggauaugcuggaucggcagaccgaccgaaagaucaggaucggcagaaagaaugccggccugcccaagucgggcgucauagccgacuggcugguacgggauaugaugcgcuuucagcccguggcgaaagacacgaguggcaagccucugaacaauagcaaggccaacagcaccgaauaccggaugcuacagcgcgcccucgcccuuuucggcggagagaaagagcgucugacaccguauuuccgccagaugaaucugacgggagggaacaauccccauccuuuccugcacgaaacccggugggagagccauaccaauauccuguccuucuaucgcagcuaucugaaagcaagaaaggcuuuucuccaaagcauaggacgaagcgaucgggaggagaaccaccgcuuccuccugcucaaggaacccaaaaccgaucggcagacauuaguggccggcuggaagagcgaauuucaucugccacgcgggauuuuuaccgaagcggucagagacugccugauagagaugggguacgaugaagucgggucauacaaggaagucggauucauggccaaagccguuccgcuauauuucgagcgggcuuguaaagaucggguacagccuuucuaugacuaccccuucaauguaggcaacagccucaagcccaagaaaggacgcuuccugagcaaagaaaagcgagccgaagagugggagagcgguaaggagcgguuccgacucgccaaacugaaaaaggaaauacucgaagccaaagaacaccccuaucucgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgacguccaugagcaggggagccucaaugugcugaaccgcgugaagccgaugcgcuugcccguggucguguacagagccgacagccgaggccauguacacaaggagcaggcuccucuggcgacggucuauaucgaagaaagggacaccaagcugcugaagcagggcaauuucaaauccuucgucaaggaucgccggcucaacggccuuuucucuuucgucgauaccggcgcacucgcgauggagcaguacccgaucagcaagcucaggguggaguacgagcuggccaaguaucagacggcaagggucugugccuucgagcagacgcuggagcuggaagagagccugcugacccgauauccucacuugccggauaagaacuucagaaagaugcucgaaagcuggucggauccucucuuggacaaguggccggaucugcaccggaaaguccggcuucugaucgcugugcgcaaugccuucucgcacaaucaguaucccauguacgacgaggccgucuuuucguccauccggaaguacgaccccucuucccccgaugccauagaggaaaggauggggcugaacaucgcgcaccgguugagcgaggaagugaagcaggcaaaagaaauggcagaacgaaucauacaaguauaa

SEQ ID NO: 11082 - RNA, 3528 nt, Artificial Sequence
  Cas13b variant__Porphyromonas gingivalis__EOA10535.1__Cas13b
augacagaacaaaacgagaaaccguacaacgguaccuacuacacgcuggaggacaaacauuucugggcagcuuucuucaaucuggcacgucacaacgccuauauuacccucacccacaucgacaggcagcucgccuacagcaaggccgauauaaccaacgaugaggauauacucuucuucaagggccaauggaaaaaccucgacaacgaucuggagaggaaagcucggcugagaaguuugauccugaagcauuucuccuuuuuggaaggagcugcauacggaaagaaacucuucgaaagccaaucuuccggaaacaaauccuccaagaagaaagaacucacgaaaaaagaaaaggaggaacugcaagccaaugcacucuccuuggacaaucugaagagcauccuguucgacuuucugcaaaagcucaaggauuucaggaauuacuacucccacuaucgacaucccgaaucuucggaauugcccuuguucgauggaaacaugcuucagagacuguacaacgucuucgaugugagugugcaacgggugaaaagagaucacgagcacaacgacaaggucgauccccaccgccacuucaaccaccuugucaggaaaggcaagaaagauaggugcggcaauaacgacaaucccuucuucaagcaccauuuugucgauagagaggagaaagucacggaagccggacugcuguuuuucgucucccucuuucuugaaaaaagggaugccaucuggaugcaaaagaagauacgaggauucaagggcggcaccgaaaccuaccagcagaugaccaacgaggucuucugccggagccggaucuccuugccgaagcucaaacuggagagccugcgcacggacgacuggaugcugcucgauaugcugaacgaacugguucgcugucccaagucguuguacgaucgucuucgcgaagaggauagagcgcguuuccgaguacccgucgauauucuguccgaugaggacgauacggacgguacggaagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaagggcagcuucuuuggccgucgccggagguaggagcaacccgaacgggacgaagcaaauacgcccaagacaaacgguucacggcagaagccuuccugagcguacaugagcugaugcccaugauguucuauuacuuccugcugagagaaaaguauuccgaggaggcaagugccgagagggugcaaggaaggaucaagagggugauagaggauguguacgcugucuacgaugcuuucgcccgaggcgaaaucgauacgcuugaccggcuggaugccuguuuggcggacaaggguauucggcgaggacaucucccccggcaaaugaucgccauauugucccaagagcauaaggauauggaggagaaaguccgcaagaaacuucaggaaaugauagcggauacggaucaccgucuggauaugcuggaucggcagaccgaccgaaagaucaggaucggcagaaagaaugccggccugcccaagucgggcgucauagccgacugguugguacgggauaugaugcgcuuucagcccguggcgaaagacacgagcggcaagccucugaacaauagcaaggccaacagcaccgaauaccggaugcuacagcgcgcccucgcccuuuucgguggagagaaagagcgucugacaccguauuuccgccagaugaaucugacgggagggaacaauccccauccuuuccugcacgagacccggugggagagccauaccaauauccuguccuucuaucgcagcuaucugaaagcaagaaaggcuuuucuccaaagcauaggacgaagcgaucggguggagaaccaccgcuuccuccugcucaaggaacccaaaaccgaucggcagacauuaguggccggcuggaagggcgaauuucaucugccacgcgggauuuuuaccgaagcggucagagacugccugauagagauggggcucgaugaagucgggucauacaaggaagucggauucauggccaaagccguuccgcuguauuucgagcgggcuuguaaagaucggguacagccuuucuaugacuaccccuucaauguaggcaacagccucaagcccaagaaaggacgcuuccugagcaaagaaaagcgagccgaagagugggagagcgguaaggagcgguuccgagaccuugaagcuuggucgcacagugcugcucgucggauagaggaugcuuuugccggaaucgagaaugcaagccgggaaaauaagaagaaaaucgagcagcuguugcaggaucucucccuuugggaaaccuuugagagcaagcugaaagucaaggcagacaagauaaauaucgccaaacugaaaaaggaaauacucgaagccaaagaacaccccuaucucgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgacguccaugagcaggggagccucaaugugcugaaccgcgugaagccgaugcgcuugcccguggucguguacagagccgacagccgaggccauguacacaaggagcaggcuccucuggcgacggucuauaucgaagaaagggacaccaagcugcugaagcagggcaauuucaaauccuucgucaaggaucgccggcucaacggccuuuucucuuucgucgauaccggcgcacucgcgauggagcaguacccgaucagcaagcucaggguggaguacgagcuggccaaguaucagacggcaagggucugugccuucgagcagacgcuggagcuggaagagagccugcugacccgauauccucacuugccggauaagaacuucagaaagaugcucgaaagcuggucggauccucucuuggacaaguggccggaucugcacgggaauguccggcuucugaucgcugugcgcaaugccuucucgcacaaucaguaucccauguacgaugagacccucuuuucguccauccggaaguacgaccccucuucccccgaugcaauagaggaaaggauggggcugaacaucgcgcaccgguugagcgaggaagugaagcaggcaaaagaaaugguagaacgaaucauacaagcauaa

SEQ ID NO: 11083 - RNA, 3360 nt, Artificial Sequence
  Cas13b variant__Porphyromonas gingivalis__WP_061156470.1__Cas13b
augacagaacaaaacgagagaccguacaacgguaccuacuacacgcuggaggacaaacauuucugggcagcuuucuucaaucuggcacgucacaacgccuauauuacccucacccacaucgacaggcagcucgccuacagcaaggccgauauaaccaacgaugaggauauacucuucuucaagggccaauggaaaaaccucgacaacgaucuggagaggaaagcucggcugagaaguuugauccugaagcauuucuccuuuuuggaaggagccgcauacggaaagaaacucuucgaaaacaaaucuuccggaaacaaauccuccaagaagaaagaacucacgaaaaaagaaaaggaggaacugcaagccaaugcacucuccuuggacaaucugaagagcauccuguucgacuuucugcaaaagcucaaggauuucaggaauuacuacucccacuaucgacaucccgaaucuucggaauugcccuuguucgauggaaacaugcuucagagacuguacaacgucuucgaugugagugugcaacgggugaaaagagaucacgagcacaacgacaaggucgauccccaccgccacuucaaccaccuugucaggaaaggcaagaaagauaggugcggcaauaacgacaaucccuucuucaagcaccauuuugucgauagagaggggaaagucacggaagccggacugcuguuuuucgucucccucuuucuugagaaaagggaugccaucuggaugcaaaagaagauccgaggcuucaagggcggcaccgaagccuaccagcagaugaccaacgaggucuucugccggagccggaucuccuugccgaagcucaaacuggagagccugcgcacggacgacuggaugcugcucgauaugcugaacgaacugguucgcugucccaagucguuguacgaucgucuucgcgaagaggauagagcgcguuuccgaguacccgucgauauucuguccgaugaggacgauacggacgguacggaagaagaccccuucaaaaacacgcuggucaggcaucaggaucgcuuccccuacuuugccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaagggcagcaucuuuggccgucgccggagguaggagcaacccgaacgggacgaagcaaauacgcccaagacaaacggcucacggcagaagccuuccugagcgugcaugagcugaugcccaugauguucuacuacuuccugcugagggagaaguauuccgaggagguaagugccgagaaggugcaaggaagaaucaagagggugauagaggauguguacgcugucuacgaugcuuucgcccgaggcgaaauugauacgcuugaccggcuggaugccuguuuggcggacaaggguauucggcgaggacaucucccccggcaaaugaucgccauauugucccaagagcauaaggauauggaggagaaaguccgcaagaaacuucaggaaaugauagcggauacggaucaccgucuggauaugcuggaucggcagaccgaccgaaagaucaggaucggcagaaagaaugccggccugcccaagucgggcgucauagccgacuggcugguacgggauaugaugcgcuuucagcccguggcgaaagacacgaguggcaagccucugaacaauagcaaggccaacagcaccgaauaccggaugcuacagcgcgcccucgcccuuuucggcggagagaaagagcgucugacaccguauuuccgccagaugaaucugacgggagggaacaauccccauccuuuccugcacgaaacccggugggagagccauaccaauauccuguccuucuaucgcagcuaucugaaagcaagaaaggcuuuucuccaaagcauaggacgaagcgaucgggaggagaaccaccgcuuccuccugcucaaggaacccaaaaccgaucggcagacauuaguggccggcuggaagagcgaauuucaucugccacgcgggauuuuuaccgaagcggucagagacugccugauagagaugggguacgaugaagucgggucauacaaggaagucggauucauggccaaagccguuccgcuauauuucgagcgggcuuguaaagaucggguacagccuuucuaugacuaccccuucaauguaggcaacagccucaagcccaagaaaggacgcuuccugagcaaagaaaagcgagccgaagagugggagagcgguaaggagcgguuccgacucgccaaacugaaaaaggaaauacucgaagccaaagaacaccccuaucucgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgaaguccaagagcaggggagccucaaugugcugaaucgcgugaagccgaugcgcuugcccguggucguguacagagccgacagccgaggccauguacacaaggagcaggcuccucuggcgacggucuauaucgaagaaagggacaccaagcugcugaagcagggcaauuucaaauccuuugucaaggaccgccggcucaacggucuuuucucuuucgucgauaccggcggacucgcgauggagcaguacccgaucagcaagcucaggguggaguacgagcuggccaaguaucagacggcaagggucugugccuucgagcagacgcuggagcuggaagagagccugcugacccgauguccucacuugccggauaagaacuucagaaagaugcucgaaagcuggucggauccucucuuggacaaguggccggaucugcaaagggaagucuggcuucugaucgcugugcgcaaugccuucucgcacaaucaguaucccauguacgacgaggccgucuuuucguccauccggaaguacgaccccucuucccccgaugccauagaggaaaggauggggcugaacaucgcgcaccgguugagcgaggaagugaagcaggcaaaagaaauggcagaacgaaucauacaagcauaa

SEQ ID NO: 11084 - RNA, 3360 nt, Artificial Sequence
  Cas13b variant__Porphyromonas gingivalis__WP_013816155.1__Cas13b
augacagaacaaaacgagaaaccguacaacgguaccuacuacacgcuggaggacaaacauuucugggcagcuuucuucaaucuggcacgucacaacgccuauauuacccucgcccacaucgacaggcagcucgccuacagcaaagccgauauaaccaacgaugaggauauacucuucuucaagggccaauggaaaaaccucgacaacgaucuggagaggaaagcucggcugagaaguuugauccugaagcauuucuccuuuuuggaaggagccgcauacggcaagaaacucuucgaaagccaaucuuccggaaacaaauccuccaagaauaaagaacucacaaaaaaagaaaaggaggagcugcaagccaaugcacucuccuuggacaaucugaagagcauccuguucgacuuucugcaaaagcucaaggauuucaggaauuacuacucccacuaucgacaucccgaaucuucggaauugcccuuguucgauggaaacaugcuucagagacuguacaacgucuucgaugugagugugcaacgggugaaaagagaucacgagcacaacgacaaggucgauccccaccgccacuucaaccaccuugucaggaaaggcaagaaagauagguacggcaauaacgacaaucccuucuucaagcaccauuuugucgauagagaggggacggucacggaagccggacugcuguuuuucgucucccucuuucuugagaaaagggaugccaucuggaugcaaaagaagauccgaggcuucaagggcggcaccgaaacuuaccagcagaugaccaacgaggucuucugccggagccggaucuccuugccgaagcucaaacuggagagccugcgcacggacgacuggaugcugcucgauaugcugaacgaacugguucgcugucccaagucguuguacgaucgucuucgcgaagaggauagagcgcguuuccgaguacccgucgauauucuguccgaugaggaggauacggacggugcggaagaagaccccuucaaaaacacgcuggucaggcaucaggaucgcuuccccuacuucgccuugcgauacuucgaucugaagaaagucuucacuucccuccgcuuccagauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaaggacagcaucuuuggccgucgccggagguaggagcaacccgaacgggacgaagcaaauacgcccaagacaaacgguucacggcagaagccuuccugagcgcacaugagcugaugcccaugauguucuauuacuuccugcugagagaaaaguauuccgaagaggcaagugccgagagggugcaaggaagaauaaagagggugauagaggauguguacgcugucuacgaugcuuucgcccgagacgaaaucaauacgcgcgacgaguuggaugccuguuuggcggacaaggguauucggcgaggacaucuccccaggcaaaugaucggcauauugucccaagagcauaaggauauggaggagaaaauccgcaagaaacuucaggaaaugauggcggauacggaucaccgucuggauaugcuggaucggcagaccgaccgaaagaucaggauuggcagaaagaaugccggccugcccaagucgggcgucauagccgacuggcugguacgggauaugaugcgcuuucagcccguggcgaaagacacgagcggcaaaccccugaacaauagcaaggccaacagcaccgaauaccggaugcuacagcgcgcccucgcccuuuucgguggagagaaagagcgucugacaccguauuuccgccagaugaaucugacgggagggaacaauccccauccuuuccugcacgagacccggugggagagccauaccaauauccuguccuucuaucgcagcuaucugaaagcaagaaaggcuuuucuccaaagcauaggacgaagcgaucggguggagaaccaccgcuuccuccugcucaaggaacccaaaaccgaucggcagacauugguggcaggcuggaagggcgaauuucaucugccacgcgggauuuuuaccgaagcggucagagacugccugauagagauggggcucgaugaagucgggucauacaaggaagucggauucauggccaaagccguuccgcuguauuucgagcgggcuuguaaagauuggguacagccuuucuauaacuaccccuucaauguaggcaacagccucaagcccaagaaaggacgcuuccugagcaaagaaaagcgugccgaagagugggagagcgguaaggagcgguuccgacucgccaaacugaaaaaggaaauacucgaagccaaagaacaccccuaucucgacuucaagucguggcagaaguucgagcgcgaacugcgccuugucaagaaucaggauauuaucacuuggaugauaugcggggaucucauggaagagaacaagguggagggauuggauaccgguacucucuaccugaaagauauucggaccgacguccaagagcaggggagccucaaugugcugaaccgcgugaagccgaugcgcuugcccguggucguguacagagccgacagccgaggccauguacacaaggagcaggcuccucuggcgacggucuauaucgaagaaagggacaccaagcugcugaagcagggcaauuucaaauccuuugucaaggaucgccggcucaacggccuuuucucuuucgucgauaccggcgcacucgcgauggagcaguacccgaucagcaagcucaggguggaguaugagcuggccaaguaucagacggcaaggguuugugccuucgagcagacgcuggagcuggaagagagccugcugacccgauguccucacuugccggauaagaacuucagaaagaugcucgaaagcuggucggauccucucuuggacaaguggccggaucugcaccggaaaguccgacuucugaucgcugugcgcaaugccuucucgcacaaucaguaucccauguacgacgaggccgucuuuucguccauccggaaguacgaccccucuuuccccgaugccauagaggaaaggauggggcugaacaucgcgcaccgguugagcgaggaagugaagcaggcaaaagaaacgguagaacgaaucauacaagcauaa

SEQ ID NO: 11085 - RNA, 3528 nt, Artificial Sequence
  Cas13b variant__Porphyromonas gingivalis__WP_005874195.1__Cas13b
augacagaacaaaacgagaaaccguacaacgguaccuacuacacgcuggaggacaaacauuucugggcagcuuucuucaaucuggcacgucacaacgccuauauuacccucgcccacaucgacaggcagcucgccuacagcaaggccgauauaaccaacgaugaggauauacucuucuucaagggccaauggaaaaaccucgacaacgaucuggagaggaaagcucggcugagaaguuugauccugaagcauuucuccuuuuuggaaggagccgcauacggcaagaaacucuucgaaagccaaucuuccggaaacaaauccuccaagaagaaagaacucacaaaaaaagaaaaggaagaacugcaagccaacgcgcucuccuuggacaaucugaagagcauccuguucgacuuucugcaaaagcucaaggauuucaggaauuacuacucccacuaucgacaucccgaaucuucggaauugcccuuguucgauggaaacaugcuucagagacuguacaacgucuucgaugugagugugcaacgggugaaaagagaucacgagcacaacgacaaggucgauccucaccgccacuucaaccaccuugucaggaaaggcaagaaagauaaguacggcaauaacgacaaucccuucuucaagcaccauuuugucgauagagaggagaaagucacggaagccggacugcuguuuuucgucucccucuuucuugaaaaaagggaugccaucuggaugcaaaagaagauccgaggcuucaagggcggcaccgaagccuaccagcagaugaccaaugaggucuucugccggagccggaucuccuugccgaagcucaaacuggagagccugcgcacggacgacuggaugcugcucgauaugcugaacgaacugguucgcugccccaagucguuguacgaucgucuucgcgaagaggauagagcgcguuuccgaguacccgucgauauucuguccgaugaggacgauacggacgguacggaagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaacaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucacccaaaccacuccgcacuaucauaucgagaaaggaaagaucgggcugagguucgugccggaagggcagcuucuuuggccgucgccggagguaggagcaacccgaacgggacgaagcaaauacgcccaagacaaacgguucacggcagaagccuuccugagcguacaugagcugaugcccaugauguucuauuacuuccugcugagagaaaaguauuccgaggaggcaagugccgagaaggugcaaggaagaauaaagagggugauagaggauguguacgcugucuacgaugcuuucgcccgagacgaaaucaauacgcgcgacgaguuggaugccuguuuggcggacaaggguauucggcgaggacaucuccccaggcaaaugaucgccauauugucccaagagcauaaggauauggaggagaaaguccgcaagaaacuucaggaaaugauagcggauacggaucaucgucuggauaugcuggaucggcagaccgaccgaaagaucaggaucggcagaaagaaugccggccugccgaagucgggugucauagccgacuggcugguacgggauaugaugcgcuuucagcccguggcgaaagacacgaguggcaagccucugaacaauagcaaggccaacagcaccgaauaccggaugcuacagcgcgcccucgcccuuuucggcggagagaaagagcgucugacaccguauuuccgccagaugaaucugacgggagggaacaauccccauccuuuccugcacgaaacccggugggagagccauaccaauauccuguccuucuaucgcagcuaucugaaagcaagaaaggcuuuucuccaaagcauaggacgaagcgaucgggaggagaaccaccgcuuccuccugcucaaggaacccaaaaccgaucggcagacauuaguggccggcuggaagagcgaauuucaucugccacgcgggauuuuuaccgaagcggucagagacugccugauagagaugggguacgaugaagucgggucauacaaggaagucggauucauggccaaagccguuccgcuauauuucgagcgggcuuguaaagaucggguacagccuuucuaugacuaccccuucaauguaggcaacagccucaagcccaagaaaggacgcuuccugagcaaagaaaagcgagccgaagagugggagagcgguaaggagcgguuccgagaccuugaggcuuggucgcacagugcugcucgucggauagaggaugcuuuugucggaaucgaguaugcaaguugggaaaauaagaagaaaaucgagcagcuguugcaggaucucucccuuugggaaaccuuugagagcaagcugaaagucaaggcagacaagauaaauauugccaaacugaaaaaggaaauacucgaagccaaagaacaccccuaucacgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgacguccaagagcaggggagccucaaugugcugaaccacgugaagccgaugcgcuugcccguggucguguacagagccgacagccgaggccauguacacaaggaggaggcuccucuggcgacggucuauaucgaagaaagggacaccaagcugcugaagcagggcaauuucaaauccuucgucaaggaucgccggcucaacggccuuuucucuuucgucgauaccggcgcacucgcgauggagcaguacccgaucagcaagcucaggguggaguacgagcuggcuaaguaucagacggcaagggucugugccuucgagcagacgcuggagcuggaagagagccugcugacccgauauccucacuugccggaugagagcuucagagagaugcucgaaagcuggucggauccucucuuggacaaguggccggaucugcaaagggaaguccggcuucugaucgcugugcgcaaugccuucucgcacaaucaguaucccauguacgaugagaccaucuuuucguccauccggaaguacgaccccucuucccucgaugccauagaggaaaggauggggcugaacaucgcgcaccgguugagcgaggaagugaagcuggcaaaagaaaugguagaacgaaucauacaagcauaa

SEQ ID NO: 11086 - RNA, 3360 nt, Artificial Sequence
  Cas13b variant__Porphyromonas gulae__WP_039437199.1__Cas13b
augacagaacaaagcgagagaccguacaacgguaccuacuacacacuggaggacaaacauuucugggcagccuuucucaaucuggcacgucacaaugccuacaucacccucacucacaucgacaggcagcucgccuacagcaaggccgauauaaccaacgaugaggauauacucuucuucaagggccaauggaaaaaccucgacaacgaucuggagaggaagucacggcugagaaguuugauccugaagcauuucuccuuuuuggaaggagcggcauacggaaagaaauucuucgaaagcaaaucuuccggaaacaaauccuccaagaauaaagaacugacaaaaaaagaaaaggaggaacugcaagccaaugcacucuccuuggacaaucugaagagcauccuguucgacuuucugcaaaagcucaaggauuucaggaauuacuauucccacuaccgacauuccggaucuucggaauugccccuguucgauggaaacaugcuucagagacuguacaacgucuucgaugugaguguccaacgggugaaaagagaucacgagcacaacgacgaggucgauccccacuaccacuucaaccaucuugucaggaaaggcaagaaggacagauacggccauaaugacaaucccuccuucaagcaccauuuugucgauggagaggggauggucacggaagccggacugcuguuuuucgucucccucuuucuugagaaaagggaugccaucuggaugcaaaagaagauccgaggcuucaagggcggcaccgaacccuacgaacagaugaccaacgaagucuucugccggagccggaucucccugccgaaacucaaacuggagagccugcgcacggacgacuggaugcugcuugauaugcugaacgaacugguucgcugucccaagccguuguacgaucgucuucgcgaaaaggauagagcguguuucagagugcccguugauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggcgagcagccggaagaccgccaucugacgcgcaaccuguacggcuucggccgaauacaggauuucgccgaggagcauagacccgaagaauggaagcguuuggugcgggauuuggacuacuucgagaccggcgacaagcccuauaucucccaaaccacuccgcacuaucauaucgagaaaggaaagaucgggcugagguucgugccggaagggcagcaucuuuggccgucgccggagguaggaacgacccgaacggggcgaagcaaauacgcccaagacaaacggcucacggcagaagcauuccugagcgugcaugagcugaugcccaugauguucuacuacuuccugcugagggagaaguauuccgaggagguaagugccgagaaggugcaaggaagaaucaagagggugauagaggauguguacgcuauauacgaugcuuucgcccgagacgaaaucaauacgcucaaggaguuggaugccuguuuggcggacaaggguauucggcgaggacaucuccccaagcaaaugaucggcauauugucccaagagcguaaggauauggaggagaaaguccgcaagaaacuucaggaaaugauagcggauacggaucaccgucuggauaugcuggaucggcagaccgaccgaaagaucaggaucggccgaaagaaugccggccugcccaagucgggcgucauagccgacuggcugguacgggauaugaugcgcuuucagcccguggcgaaagacacgagcggcaagccccugaacaauagcaaggccaacagcaccgaauaccggaugcuacagcgcgcccucgcccuuuucgguggagagaaggaacgucugaccccguauuuccgccagaugaaucugacgggagggaacaauccccauccuuuccugcacgagacccggugggagagccauaccaauauccuguccuucuaucgcagcuaucugagagcaagaaaggcuuuccucgaacgcauagggcgaagcgaucggguggagaauugccccuuccuccugcucaaggaacccaaaaccgaucggcagacauugguggcaggcuggaagggcgaauuucaucugccacguggaauuuuuaccgaagcggucagagacugccugauagagaugggguacgaugaagucgggucauacagggaagucggauucauggccaaagccguuccgcuguauuucgagcgggcuugugaagaccggguacagccuuucuaugacagccccuuuaauguaggcaacagccucaagcccaagaaaggacgcuuccugagcaaagaaaagcgugccgaagagugggagagcgguaaggagcgguuccgacucgccaaacugaaaaaggaaauacucgaagcccaagaacaccccuaucacgacuucaagucguggcagaaguucgagcgcgaacugcgccuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggaggcuccucuggcgacggucuauaucgaagagagagacaccaagcugcugaagcaggguaauuucaaauccuuugucaaggaucgccggcucaacggccuuuucucuuucgucgauaccggcgcacucgcgauggagcaguacccgaucagcaagcucaggguggaguacgagcuggccaaguaucagacggcaagggucugugccuucgagcagacgcuggagcuggaagagagccugcugacccgauauccucacuugccggaugagagcuucagagagaugcucgaaagcuggucggauccucucuugaccaaguggccggagcugcacgggaaaguccggcuucugaucgcugugcgcaaugccuucucgcacaaucaguaucccauguacgaugaggccgucuuuucguccauuuggaaguacgaccccucuucccccgaugccauagaggaaaggauggggcugaacaucgcgcaccgguugagcgaggaagugaagcaggcaaaagaaacgauagaacgaaucauacaagcauaa

SEQ ID NO: 11087 - RNA, 3360 nt, Artificial Sequence
  Cas13b variant__Porphyromonas gulae__WP_039419792.1__Cas13b
augacagaacaaagcgagagaccguacaacgguaccuacuacacacuggaggacaaacauuucugggcagccuuccucaaucuggcacgucacaaugccuacaucacccucacccauaucgacagacagcucgccuacagcaaggccgauauaaccaacgaucaggauguacucucuuucaaagcccuauggaaaaaccucgacaacgaucuggagaggaagucacggcugagaaguuugauccugaagcauuucuccuuuuuggaaggagcggcauacggaaagaaacucuucgaaagcaaaucuuccggaaacaaauccuccaagaauaaagaacugacaaaaaaagaaaaggaggagcugcaagccaaugcacucuccuuggacaaucugaagagcauccuguucgacuuucuacaaaagcucaaggauuucagaaauuacuacucccacuaccgacauuccggaucuucggaauugccccuguucgauggaaacaugcuucagagacuguacaacgucuucgaugugaguguccaacgggugaaaagagaucacgagcacaacgacaaggucgauccccaccgccauuucaaccaucuugucaggaaaggcaagaaggacagauacggccauaacgacaaucccuccuucaagcaccauuuugucgauggagaggggauggucacggaagccggacugcuguuuuucgucucccucuuucuugagaaaagggaugccaucuggaugcaaaagaagauccgaggcuucaaggguggcaccgaaaccuaccagcagaugaccaacgaagucuucugccggagccggaucuccuugccgaagcucaaacuggagagccugcgcacggacgacuggaugcugcucgauaugcugaacgaacugguucgcugucccaagccguuguacgaucgucuucgugaaaaggauagagcgcguuucagagugcccguugauauucuucccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaaggugaucggcgagcagccggaagaccgccaucugacgcgcaaccuguacggcuucggccgaauacaggauuucgccgaggagcauagacccgaagaguggaagcguuuggugcgggauuuggacuacuucgagaccggcgacaagcccuauaucucccaaaccacuccgcacuaucauaucgagaaaggcaagaucgggcugagguucgugccggaagggcagcaucuuuggccgucgccggagguaggaacgacccgaacggggcgaagcaaauacgcccaagacaaacggcucacggcagaagcauuccugagcgugcaugagcugaugcccaugauguucuacuacuuccugcugagggagaaguauuccgaggagguaagugccgagaaggugcaaggaaggaucaagagggugauagaggauguguacgcuauauacgaugcuuucgcccgagacgaaaucaauacgcgcgacgaguuggaugccuguuuggcggacaaggguauucggcgaggacaucuccccaagcaaaugaucggcauauugucccaagaacauaagaauauggaggagaaaguccgcaagaaacuucaggaaaugauagcggauacggaucaucgucuggauaugcuggaucggcagaccgaccgaaagaucaggaucggccgaaagaaugccggccugcccaagucgggcgucauagccgacuggcugguacgggauaugaugcgcuuucagcccguggcgaaagacacgagcggcaagccccugaacaauagcaaggccaacagcaccgaauaccggaugcuacagcgcgcccucgcccuuuucgguggagagaaggaacgucugaccccguauuuccgccagaugaaucugacgggagggaacaauccccauccuuuccuggacgagacccggugggagagccauaccaauauccuguccuucuaucguagcuaucugagagcaagaaaggcuuuccucgaacguauagggcgaagcgaucggguggagaaucgccccuuccuccugcucaaggaacccaaaaccgaucgacagacauugguggcaggcuggaagagcgaauuucaucugccacgcgggauuuuuaccgaagcggucagagacugccugauagagaugggguacgaugaagucgggucauacaaggaagucggauucauggccaaagccguuccgcuauauuucgagcgggcuuguaaagaucggguacagccuuucuaugacucccccuucaauguaggcaacagccucaagcccaagaaaggacgcuuccugagcaaagaaaagcgagccgaagagugggagagcgguaaggagcgguuccgacucgccaaacugaaaaaggaaauacucgaagcccaagaacaccccuaucacgacuucaagucguggcagaaguucgagcgcgaacugcgacuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggaggcuccucuggcgacggucuauaucgaagagagggacaccaagcugcugaagcagggcaauuucaaauccuuugucaaggaucgccggcucaacggccuuuucucuuucgucgauaccggcggacucgcgauggagcaguacccgaucagcaagcucaggguggaguacgagcuggccaaguaucagacggcaagggucugugucuucgagcugacgcucaggcuggaagagagucugcugagccgguauccucacuugccggaugagagcuucagagagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaagcauaa

SEQ ID NO: 11088 - RNA, 3528 nt, Artificial Sequence
  Cas13b variant__Porphyromonas gulae__WP_039431778.1__Cas13b
augacagaacaaagcgagagaccguacaacgguaccuacuacacacuggaggacaaacauuucugggcagccuuccucaaucuggcacgucacaaugccuacaucacccucacucauaucgacagacagcucgccuacagcaaggccgauauaaccaacgaucaggauguacucuccuucaaagcccuauggaaaaacuucgacaacgaucuggagaggaagucacggcugagaaguuugauccugaagcauuucuccuuuuuggaaggagcggcauacggaaagaaacucuucgaaagcaaaucuuccggaaacaaauccuccaagaauaaagaacugacaaaaaaagaaaaggaggagcugcaagccaaugcacucuccuuggacaaucugaagagcauccuguucgacuuucuacaaaagcucaaggauuucaggaauuacuauucccacuaucgacauuccgaaucuucggaauugccccuguucgauggaaacaugcuucagagacuguacaacgucuucgaugugaguguccaacgggugaaaagagaucacgagcacaacgacaaggucgauccccaccgccauuucaaccaccuugucaggaaaggcaagaaggacagauacggccauaaugacaaucccuccuucaagcaccauuuugucgauggagaggggauggucacggaagccggacugcuguuuuucgucucccucuuucuugagaaaagggaugccaucuggaugcaaaagaagauccgaggcuucaaggguggcaccgaaaccuaccagcagaugaccaacgaagucuucugccggagccggaucucccugccgaagcucaaacuggagagccugcgcacggacgacuggaugcugcucgauaugcugaacgaacugguucgcugucccaagccguuguacgaucgucuucgcgaagacgauagagcguguuucagagugcccgucgauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggugagcagccggaagaccgccaucugacgcgcaaccuguacggcuucggccgaauacaggauuucgccgaggagcauagacccgaagaguggaagcguuuggugcgggauuuggacuacuucgagaccggcgacaagcccuauaucucccaaaccucuccgcacuaucauaucgagaaaggcaagaucgggcugagguucaugccggaagggcagcaucuuuggccgucgccggagguaggaacgacccgaacggggcgaagcaaauaugcccaagacaaacggcucacggcagaagccuuccugagcgugcaugagcugaugcccaugauguucuacuacuuccugcugagggagaaguauuccgaggagguaagugccgagaaggugcaaggaagaaucaagagggugauagaggauguguacgcuauauacgaugcuuucgcccgagacgaaaucaauacgcucaaggaguuggaugccuguuuggcggacaaggguauucggcgaggacaucuccccaagcaaaugaucgccauauugucccaagaacauaaggauauggaggagaaaauccgcaagaaacuucaggaaaugauagcggauacggaucaucgucuggauaugcuggaucggcagaccgaccgaaagaucaggaucggcagaaagaaugccggccugcccaagucgggcgucauagccgacuggcugguacgggauaugaugcgcuuucagcccguggcgaaagacacgagcggcaagccccugaacaauagcaaggccaacagcaccgaauaccggaugcuacagcgcgcccucgcccuuuucgguggagagaagaagcgucugacgccguauuuccgccagaugaaucugacaggagggaacaauccccauccuuuccugcacgagacccggugggagagccauaccaauauccuguccuucuaucgcagcuaucugagagcaagaaaggcuuuccucgaacgcauagggcgaagcgaucggauggagaaucgccccuuccuccugcucaaggaacccaaaaccgaucgacagacauugguggcaggcuggaagagcgaauuucaucugccacgcgggauuuuuaccgaagcggucagagacugccugauagagaugggguacgaugaagucgggucauacagggaagucggauucauggccaaagccguuccgcuguauuucgagcgagcuugugaagaccguguacagccuuucuaugacagccccuucaauguaggcaacagccucaagcccaagaaaggacgcuuccugagcaaagaagagcgagccgaagagugggagagagguaaggagcgguuccgagaccuugaggcuuggucgcacagugcugcucgucggauagaggaugcuuuugccggaaucgaguaugcaaguccgggaaauaagaagaaaaucgagcagcuguugcgggaucucucccuuugggaagccuuugagagcaagcugaaagucagggcagacaagaucaaucucgccaaacugaaaaaggaaauacucgaagcccaagaacaccccuaucacgacuucaagucguggcagaaguucgagcgcgaacugcgccuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggaggcuccucuggcgacggucuauaucgaagagagagacaccaagcugcugaagcagggcaauuucaaauccuuugucaaggaucgccggcucaacggucuuuucucuuucgucgauaccggcggacucgcgauggagcaguacccgaucagcaagcucaggguggaguacgagcuggccaaguaucagacggcaagggucugugucuucgagcugacgcucaggcuggaagagagucugcugacccgguauccucacuugccggaugagagcuucagaaagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaaguauaa

SEQ ID NO: 11089 - RNA, 3528 nt, Artificial Sequence
  Cas13b variant__Porphyromonas gulae__WP_046201018.1__Cas13b
augacagaacaaagcgagagaccguacaacgguaccuacuacacacuggaggacaaacauuucugggcagccuuccucaaucuggcacgucacaaugccuacaucacccucacucauaucgacagacagcucgccuacagcaaggccgauauaaccaacgaucaggauguacucuccuucaaagcccuauggaaaaacuucgacaacgaucuggagaggaagucacggcugagaaguuugauccugaagcauuucuccuuuuuggaaggagcggcauacggaaagaaacucuucgaaagcaaaucuuccggaaacaaauccuccaagaauaaagaacugacaaaaaaagaaaaggaggagcugcaagccaaugcacucuccuuggacaaucugaagagcauccuguucgacuuucuacaaaagcucaaggauuucaggaauuacuauucccacuaucgacauuccgaaucuucggaauugccccuguucgauggaaacaugcuucagagacuguacaacgucuucgaugugaguguccaacgggugaaaagagaucacgagcacaacgacaaggucgauccccaccgccauuucaaccaccuugucaggaaaggcaagaaggacagauacggccauaaugacaaucccuccuucaagcaccauuuugucgauagugaggggauggucacggaagccggacugcuguuuuucgucucccucuuucuugagaaaagggaugccaucuggaugcaaaagaagauccgaggcuucaaggguggcaccgaaaccuaccagcagaugaccaacgaagucuucugccggagccggaucuccuugccgaagcucaaacuggagagccugcgcacggacgacuggaugcugcucgauaugcugaacgaacugguucgcugucccaagccguuguacgaucgucuucgugaaaaggauagagcgcguuucagagugcccguugauauucuucccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggcgagcagccggaagaccgccaucugacgcgcaaccuguacggcuucggccgaauacaggauuuugccgaggagcauagacccgaagaguggaagcguuuggugcgggauuuggacuacuucgagaccggcgacaagcccuauaucucccaaaccacuccgcacuaucauaucgagaaaggcaagaucgggcugagguucaugccggaagggcagcaucuuuggccgucgccggagguaggaacgacccgaacggggcgaagcaaauacgcccaagacaaacggcucacggcagaagcauuccugagcgugcaugagcugaugcccaugauguucuacuacuuccugcugagggagaaguauuccgaggagguaagugccgagaaggugcaaggaagaaucaagagggugauagaggauguguacgcuauauacgaugcuuucgcccgagacgaaaucaauacgcucaaggaguuggaugccuguuuggcggacaaggguauucggcgaggacaucuccccaagcaaaugaucgccauauugucccaagaacauaaggauauggaggagaaaauccgcaagaaacuucaggaaaugauagcggauacggaucaucgucuggauaugcuggaucggcagaccgaccgaaagaucaggaucggcagaaagaaugccggccugcccaagucgggcgucauagccgacuggcugguacgggauaugaugcgcuuucagcccguggcgaaagacacgagcggcaagccccugaacaauagcaaggccaacagcaccgaauaccggaugcuacagcgcgcccucgcccuuuucgguggagagaagaagcgucugacgccguauuuccgccagaugaaucugacaggagggaacaauccccauccuuuccugcacgagacccggugggagagccauaccaauauccuguccuucuaucgcagcuaucugagagcaagaaaggcuuuccucgaacgcauagggcgaagcgaucggauggagaaucgccccuuccuccugcucaaggaacccaaaaccgaucgacagacauugguggcaggcuggaagagcgaauuucaucugccacgcgggauuuuuaccgaagcggucagagacugccugauagagaugggguacgaugaagucgggucauacagggaagucggauucauggccaaagccguuccgcuguauuucgagcgagcuugugaagaccguguacagccuuucuaugacagccccuucaauguaggcaacagccucaagcccaagaaaggacgcuuccugagcaaagaagagcgagccgaagagugggagagagguaaggagcgguuccgagaccuugaggcuuggucgcacagugcugcucgucggauagaggaugcuuuugccggaaucgaguaugcaaguccgggaaauaagaagaaaaucgagcagcuguugcgggaucucucccuuugggaagccuuugagagcaagcugaaagucagggcagacaagaucaaucucgccaaacugaaaaaggaaauacucgaagcccaagaacaccccuaucacgacuucaagucguggcagaaguucgagcgcgaacugcgccuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggaggcuccucuggcgacggucuauaucgaagagagagacaccaagcugcugaagcagggcaauuucaaauccuuugucaaggaucgccggcucaacggucuuuucucuuucgucgauaccggcggacucgcgauggagcaguacccgaucagcaagcucaggguggaguacgagcuggccaaguaucagacggcaagggucugugucuucgagcugacgcucaggcuggaagagagucugcugacccgguauccucacuugccggaugagagcuucagaaagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaaguauaa

SEQ ID NO: 11090 - RNA, 3525 nt, Artificial Sequence
  Cas13b variant__Porphyromonas gulae__WP_039442171.1__Cas13b
augacagaacaaagcgagagaccguacaacgguaccuacuacacacuggaggacaaacauuucugggcagccuuucucaaucuggcacgucacaaugccuacaucacccucacucauaucgacagacagcucgccuacagcaaggccgauauaaccaacgaucaggauguacucucuuucaaagcccuauggaaaaaccucgacaacgaucuggagaggaagucacggcugagaaguuugauccugaagcauuucuccuuuuuggaaggagcggcauacggaaagaaacucuucgaaagcaaaucuuccggaaacaaauccuccaagaauaaagaacugacaaaaaaagaaaaggaggagcugcaagccaaugcacucuccuuggacaaucugaagagcauccuguucgacuuucuacaaaagcucaaggauuucagaaauuacuacucccacuaccgacauuccggaucuucggaauugccccuguucgauggaaacaugcuucagagacuguacaacgucuucgaugugaguguccaacgggugaaaagagaucacgagcacaacgacaaggucgauccccacuaccacuucaaccaucuugucaggaaaggcaagaaggacagauacggccauaacgacaaucccuccuucaagcaccauuuugucgauagugaggggauggucacggaagccggacugcuguuuuucgucucccucuuucuugagaaaagggaugccaucuggaugcaaaagaagauccgaggcuucaagggcggcaccggacccuacgagcagaugaccaacgaagucuucugccggagccggaucucccugccgaaacucaaacuggagagccugcgcacggacgacuggaugcugcuugauaugcugaacgaacugguucgcugucccaagccguuguacgaucgucuucgcgaaaaggauagagcguguuucagagugcccguugauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggugagcagccggaagaccgccaucugacgcgcaaccuguacggcuucggccgaauacaggauuucgccgaggagcauagacccgaagaauggaagcguuuggugcgggauuuggacuaccucgagaccggcgacaagcccuauaucucccaaacuacuccgcacuaucauaucgagaaaggaaagaucgggcugagguucgugccggaagggcagcaucuuuggccgucgccggagguaggaacgacccgaacggggcgaagcaaaugugcccaagacaaacggcucacggcagaagccuuccugagcgugcaugagcugaugcccaugauguucuacuacuuccugcugagggagaaguauuccgaggagguaagugccgagaaggugcaaggaagaaucaagagggugauagaggauguguacgcuauauacgaugcuuucgcccgagacgaaaucaauacgcucaaggaguuggauaccuguuuggcagacaaggguauucggcgaggacaucucccgaagcaaaugaucaccauauugucccaagagcguaaggauaugaaggagaaaauccgcaagaaacuucaggaaaugauagcggauacggaucaucgucuggauaugcuggaucggcagaccgaccgaaagaucaggaucggccgaaagaaugccggccugcccaagucgggcgucauagccgacuggcugguacgggauaugaugcgcuuucagcccguggcgaaagacgcaagcggcaagccccugaacaauagcaaggccaacagcaccgaauaccggaugcuacagcgcgcccucgcccuuuucgguggagagaaggaacgucugacaccguauuuccgucagaugaaucugacgggagggaacaauccccauccuuuccugcacgagacccggugggagagccauaccaauauccuguccuucuaucgcagcuaucugagagcaagaaaggcuuuccucgaacgcauagggcgaagcgaucggguggagaauugccccuuccuccugcucaaggaacccaaaaccgaucggcagacauugguggcaggcuggaaggacgaauuucaucugccacgcgggauuuuuaccgaagcggucagagacugccugauagagaugggguacgaugaagucgggucauacagggaagucggauucauggccaaagccguuccgcuguauuucgagcgggcuugugaagaccggguacagccuuucuaugacagccccuucaauguaggcaacagccucaagcccaagaaaggacgcuuccugagcaaagaagaccgagccgaagagugggagagagguauggagcgguuccgagaccuugaggcuuggucgcacagugcugcucgucggauaaaagaugcuuuugccggaaucgaguaugcaaguccgggaaauaagaagaaaaucgaacagcuguugcgggaucucucccuuugggaagccuuugagagcaagcugaaagucagggcagacaagaucaaucucgccaaacugaaaaaggaaauacucgaagcccaagaacaccccuaucacgacuucaagucguggcagaaguucgagcgcgaacugcgacuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggcuccucuggcgacggucuauaucgaagagaggaacaccaagcugcugaagcagggcaauuucaaauccuuugucaaggaucgccggcucaacggccuuuucucuuucgucgauaccggcggacucgcgauggagcaguacccgaucagcaagcucaggguggaguacgagcuggccaaguaucagacggcaagggucugugucuucgagcugacgcucaggcuggaagagagucugcugagccgguauccucacuugccggaugagagcuucagagagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaagcauaa

SEQ ID NO: 11091 - RNA, 3360 nt, Artificial Sequence
  Cas13b variant__Porphyromonas gulae__WP_039426176.1__Cas13b
augacagaacaaagcgagagaccguacaacgguaccuacuacacacuggaggacaaacauuucugggcagccuuccucaaucuggcacgucacaaugccuacaucacccucacccauaucgacagacagcucgccuacagcaaggccgauauaaccaacgaucaggauguacucuccuucaaagcccuauggaaaaacuucgacaaugaucuggagaggaagucacggcugagaaguuugauccugaagcauuucuccuuuuuggaaggagcggcauacggaaagaaacucuucgaaagcaaaucuuccggaaacaaauccuccaagaauaaagaacugacgaaaaaagaaaaggaggagcugcaagccaaugcgcucuccuuggacaaucugaagagcauccuguucgacuuucuacaaaagcucaaggauuucagaaauuacuacucccacuaccgacauuccggaucuucggaauugccccuguucgauggaaacaugcuucagagacuguacaacgucuucgaugugaguguccaacgggugaaaagagaucacgagcacaacgacaaggucgauccccacuaccacuucaaccaucuugucaggaaaggcaagaaggacagauacggccauaacgacaaucccuccuucaagcaccauuuugucgauagugaggggauggucacggaagccggacugcuguuuuucgucucccucuuucuugagaaaagggaugccaucuggaugcaaaagaagauccgaggcuucaagggcggcaccggacccuacgagcagaugaccaacgaagucuucugccggagccggaucucccugccgaaacucaaacuggagagccugcgcacggacgacuggaugcugcuugauaugcugaacgaacugguucgcugucccaagccguuguacgaucgucuucgcgaaaaggauagagcguguuucagagugcccguugauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggugagcagccggaagaccgccaucugacgcgcaaccuguacggcuucggccgaauacaggauuucgccgaggagcauagacccgaagaguggaagcguuuggugcgggauuuggacuacuucgagaccggcgacaagcccuauaucucccaaaccacuccgcacuaucauaucgagaaaggcaagaucgggcugagguucaugccggaagggcagcaucuuuggccgucgccggagguaggaacgacccgaacggggcgaagcaaauacgcccaagacaaacggcucacggcagaagccuuccugagcgugcaugagcugaugcccaugauguucuacuacuuccugcugagggagaaguauuccgaggagguaagugccgagaaggugcaaggaagaaucaagagggugauaaaggauguguacgcuauauacgaugcuuucgcccgagacgaaaucaauacgcucaaggaguuggaugccuguucggcggacaaggguauucggcgaggacaucuccccaagcaaaugaucggcauauugucccaagaacauaagaauauggaggagaaaguccgcaagaaacuucaggaaaugauagcggauacggaucaucgucuggauaugcuggaucggcagaccgaccgaaagaucaggaucggcagaaagaaugccggccugcccaagucgggcgucauagccgacuggcugguacgggauaugaugcgcuuucagcccguggcgaaagacacgagcggcaagccccugaacaauagcaaggccaacagcaccgaauaccggaugcuacagcgcgcccucgcccuuuucgguggagagaaggaacgucugaccccguauuuccgccagaugaaucugacgggagggaacaauccccauccuuuccuggacgagacccggugggagagccauaccaauauccuguccuucuaucguagcuaucugagagcaagaaaggcuuuccucgaacguauagggcgaagcgaucggguggagaaucgccccuuccuccugcucaaggaacccaaaaacgaucggcagacauuaguggccggcuggaagagcgaauuucaucugccacgcgggauuuuuaccgaagcggucagagacugccugauagagaugggguacgaugaagucgggucauacaaggaagucggauucauggccaaagccguuccgcuauauuucgagcgggcuuguaaagaucggguacagccuuucuaugacucccccuucaauguaggcaacagccucaagcccaagaaaggacgcuuccugagcaaagaaaagcgagccgaagagugggagagcgguaaggagcgguuccgacucgccaaacugaaaaaggaaauacucgaagccaaagaacaccccuaucacgacuucaagucguggcagaaguucgagcgcgaacugcgccuugucaagaaucaggauauuaucacuuggaugaugugcagggaucucauggaagagaacaagguggagggauuggauaccgguacucucuaccugaaagauauucggaccgacguccaugagcaggggagccucaaugugcugaaccgcgugaagccgaugcgcuugcccguggucguguacagagccgacagccggggccauguacacaaggagcaggcuccucuggcgacggucuauaucgaagaaagggacaccaagcugcugaagcagggcaauuucaaauccuuugucaaggaucgccggcucaacggccuuuucucuuucgucgauaccggcggacucgcgauggagcaguacccgaucagcaagcucaggguggaguacgagcuggccaaguaucagacggcaagggucugugccuucgagcagacgcuggagcuggaagagagccugcugacccgauauccucacuugccggaugagaacuucagagagaugcucgaaagcuggucggauccucucuugggcaaguggccggaucugcacgggaaaguccggcuucugaucgcugugcgcaaugccuucucgcacaaucaguaucccauguacgacgaggccgucuuuucguccauccggaaguacgaccccucuucccccgaugccauagaagaaaggaugggacugaacaucgcgcaccgguugagcgaggaagugaagcaggcaaaagaaacgguagaacgaaucauacaagcauaa

SEQ ID NO: 11092 - RNA, 3528 nt, Artificial Sequence
  Cas13b variant__Porphyromonas gulae__WP_039418912.1__Cas13b
augacagaacaaagcgagagaccguacaacgguaccuacuacacacuggaggacaaacauuucugggcagccuuccucaaucuggcacgucacaaugccuacaucacccucacccauaucgacagacagcucgcauacagcaaggccgauauaaccaacgaucaggauguacucuccuucaaagcccuauggaaaaaccucgacaacgaucuggaaaggaagucacggcugagaaguuugauccugaagcauuucuccuuuuuggaaggagcggcauacggaaagaaacucuucgaaagcaaaucuuccggaaacaaauccuccaagaauaaagaacugacaaaaaaagaaaaggaggagcugcaagccaaugcgcucuccuuggacaaucugaagagcauccuguucgacuuucuacaaaagcucaaggauuucagaaauuacuacucccacuaccgacauuccggaucuucggaauugccccuguucgauggaaacaugcuucagagacuguacaacgucuucgaugugaguguccaacgggugaaaagagaucacgagcacaacgacaaggucgauccccaccgccauuucaaccaccuugucaggaaaggcaagaaggacagauacggccauaaugacaaucccuccuucaagcaccauuuugucgauagugaggggauggucacggaagccggacugcuguuuuucgucucccucuuucuugagaaaagggaugccaucuggaugcaaaagaagauccgaggcuucaaggguggcaccgaaaccuaccagcagaugaccaacgaagucuucugccggagccggaucucccugccgaaacucaaacuggagagccugcgcauggacgacuggaugcugcuugauaugcugaacgaacugguucgcugucccaagccguuguacgaucgucuucgcgaagacgauagagcguguuucagagugcccgucgauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggugagcagccggaagaccgccaucugacgcgcaaccuguacggcuucggccgaauacaggauuucgccgaggagcauagacccgaagaguggaagcguuuggugcgggauuuggacuacuucgagaccggcgacaagcccuauaucucccaaaccucuccgcacuaucauaucgagaaaggcaagaucgggcugagguucaugccggaagggcagcaucuuuggccgucgccggagguaggaacgacccgaacggggcgaagcaaauaugcccaagacaaacggcucacggcagaagccuuccugagcgugcaugagcugaugcccaugauguucuacuacuuccugcugagggagaaguauuccgaggagguaagugccgagaaggugcaaggaagaaucaagagggugauagaggauguguacgcuauauacgaugcuuucgcccgagacgaaaucaauacgcucaaggaguuggaugccuguuuggcggacaaggguauucggcgaggacaucuccccaagcaaaugaucgccauauugucccaagaacauaagaauauggaggagaaaguccgcaagaaacuucaggaaaugauagcggauacggaucaucgucuggauaugcuggaucggcagaccgaccgaaagaucaggaucggccgaaagaaugccggccugcccaagucgggcgucauagccgacuggcugguacgggauaugaugcgcuuucagcccguggcgaaagacgcaagcggcaagccccugaacaauagcaaggccaacagcaccgaauaccggaugcuacagcgcgcccucgcccuuuucgguggagagaaggagcgucugaccccguauuuccgccagaugaaucugacgggagggaacaauccccauccuuuccugcacgauacccggugggagagccauaccaauauccugucuuucuaucgcagcuaucugagagcaagaaaggcuuuccucgaacgcauagggcgaagcgaucggauggagaaucgccccuuccuccugcucaaggaacccaaaaccgaucgacagacauugguggcaggcuggaagagcgaauuucaucugccacgcgggauuuuuaccgaagcggucagagacugccugauagagaugggguacgaugaagucgggucauacagggaagucggauucauggccaaagccguuccgcuguauuucgagcgagcuugugaagaccguguacagccuuucuaugacagccccuucaauguaggcaacagccucaagcccaagaaaggacgcuuccugagcaaagaagagcgagccgaagagugggagagagguaaggagcgguuccgagaccuugaggcuuggucgcacagugcugcucgucggauagaggaugcuuuugccggaaucgaguaugcaaguccgggaaauaagaagaaaaucgagcagcuguugcgggaucucucccuuugggaagccuuugagagcaagcugaaagucagggcagacaagaucaaucucgccaaacugaaaaaggaaauacucgaagcccaagaacaccccuaucacgacuucaagucguggcagaaguucgagcgcgaacugcgccuugucaagaaucaggauauuaucacuuggaugaugugccgggaucucauggaagagaacaagguggagggauuggauaccgguacucucuaccugaaagauauucggaccaacguccaagagcagggaagccucaaugugcugaaccacgugaagccgaugcgcuugcccguggucguguacagagccgacagccgaggccauguacacaaggaggaggcuccucuggcgacggucuauaucgaagaaagggacaccaagcugcugaagcaggguaauuucaaauccuucgucaaggaucgccggcucaacggccuuuucucuuucgucgauaccggcggacucgcgauggagcaguacccgaucagcaagcucaggguggaguacgagcuggccaaguaucagacggcaagggucugugccuucgagcagacgcuggagcuggaagagagccugcugacccgauauccucacuugccggauaagaacuucagaaagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaagcauaa

SEQ ID NO: 11093 - RNA, 3528 nt, Artificial Sequence
  Cas13b variant__Porphyromonas gulae__WP_039434803.1__Cas13b
augacagaacaaagcgagagaccguacaacgguaccuacuacacacuggaggacaaacauuucugggcagccuuccucaaucuggcacgucacaaugccuacaucacccucacucauaucgacagacagcucgccuacagcaaggccgauauaaccaacgaucaggauguacucuccuucaaagcccuauggaaaaacuucgacaacgaucuggagaggaagucacggcugagaaguuugauccugaagcauuucuccuuuuuggaaggagcggcauacggaaagaaacucuucgaaagcaaaucuuccggaaacaaauccuccaagaauaaagaacugacaaaaaaagaaaaggaggagcugcaagccaaugcacucuccuuggacaaucugaagagcauccuguucgacuuucugcaaaagcucaaggauuucaggaauuacuauucccacuaccgacauuccggaucuucggaauugccccuguucgauggaaacaugcuucagagacuguacaacgucuucgaugugaguguccaacgggugaaaauagaucacgagcacaacgacgaggucgauccccacuaccacuucaaccaucuugucaggaaaggcaagaaggacagauacggccauaaugacaaucccuccuucaagcaccauuuugucgauggagaggggauggucacggaagccggacugcuguuuuucgucucccucuuucuugagaaaagggaugccaucuggaugcaaaagaagauccgaggcuucaaggguggcaccgaaaccuaccagcagaugaccaacgaagucuucugccggagccggaucucccugccgaaacucaaacuggagagccugcgcauggacgacuggaugcugcuugauaugcugaacgaacugguucgcugucccaagccguuguacgaucgucuucgcgaagacgauagagcguguuucagagugcccgucgauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggugagcagccggaagaccgccaucugacgcgcaaccuguacggcuucggccgaauacaggauuucgccgaggagcauagacccgaagaguggaagcguuuggugcgggauuuggacuacuucgagaccggcgacaagcccuauaucucccaaaccucuccgcacuaucauaucgagaaaggcaagaucgggcugagguucaugccggaagggcagcaucuuuggccgucgccggagguaggaacgacccgaacggggcgaagcaaauaugcccaagacaaacggcucacggcagaagccuuccugagcgugcaugagcugaugcccaugauguucuacuacuuccugcugagggagaaguauuccgaggagguaagugccgagagggugcaaggaagaauaaagagggugauagaggauguguacgcugucuacgaugcuuucgcccgagacgaaaucaauacgcgcgacgaguuggaugccuguuuggcggacaaggguauucggcgaggacaucuccccaggcaaaugaucgccauauugucccaagagcauaaggauauggaggagaaaauccgcaagaaacuucaggaaaugauggcggauacggaucaucgucuggauaugcuggaucggcagaccgaccgaaagaucaggaucggccgaaagaaugccggccugcccaagucgggcgucauagccgacuggcugguacgggauaugaugcgcuuucagcccguggcgaaagacgcaagcggcaagccccugaacaauagcaaggccaacagcaccgaauaccggaugcuacagcgcgcccucgcccuuuucgguggagagaaggaacgucugacaccguauuuccgucagaugaaucugacgggagggaacaauccccauccuuuccugcacgagacccggugggagagccauaccaauauccuguccuucuaucgcagcuaucugagagcaagaaaggcuuuccucgaacgcauagggcgaagcgaucggguggagaaucgccccuuccuccugcucaaggaacccaaaaccgaucggcagacauugguggcaggcuggaagggcgaauuucaucugccacgcgggauuuuuaccgaagcggucagagacugccugauagagauggggcacgaugaaguugcgucauacaaggaagucggauucauggccaaagccguuccgcuguauuucgagcgagcuugugaagaccguguacagccuuucuaugacagccccuucaauguaggcaacagccucaagcccaagaaaggacgcuuccugagcaaagaagagcgagccgaagagugggagagagguaaggagcgguuccgagaccuugaggcuuggucguacagugcugcucgucggauagaggaugcuuuugcuggaaucgaguaugcaaguccgggaaauaagaagaaaaucgagcagcuguugcgggaucucucccuuugggaagccuuugagagcaagcugaaagucagggcagacaggaucaaucucgccaaacugaaaaaggaaauacucgaagcccaagaacaccccuaucacgacuucaagucguggcagaaguucgagcgcgaacugcgccuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggaggcuccucuggcgacggucuauaucgaagagagggacaccaagcugcugaagcagggcaauuucaaauccuuugucaaggaucgccggcucaacggccuuuucucuuucgucgauaccggcggacucgcgauggagcaguacccgaucagcaagcucaggguggaguacgagcuggccaaguaucagacggcaagggucugugucuucgagcugacgcucaggcuggaagagagucugcugacccgguauccucacuugccggaugagagcuucagagagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaagcauaa

SEQ ID NO: 11094 - RNA, 3528 nt, Artificial Sequence
  Cas13b variant__Porphyromonas sp.__WP_039428968.1__Cas13b
augacagaacaaagcgagagaccguacaacgguaccuacuacacacuggaggacaaacauuucugggcagccuuccucaaucuggcacgucacaaugccuacaucacccucacccauaucgacagacagcucgccuacagcaaggccgauauaaccaacgaucaggauguacucuccuucaaagcccuauggaaaaacuucgacaaugaucuggagaggaagucacggcugagaaguuugauccugaagcauuucuccuuuuuggaaggagcggcauacggaaagaaacucuucgaaagcaaaucuucuggaaacaaauccuccaagaauaaagaacugacaaaaaaagaaaaggaggagcugcaagccaaugcacucuccuuggacaaucugaagagcauccuguucgacuuucuacaaaagcucaaggauuucaggaauuacuauucccacuaucgacauuccgaaucuucggaauugccccuguucgauggaaacaugcuucagagacuguacaacgucuucgaugugaguguccaacgggugaaaagagaucacgagcacaacgacaaggucgauccccaccgccauuucaaccaccuugucaggaaaggcaagaaggacagauacggccauaaugacaaucccuccuucaagcaccauuuugucgauagugaggggauggucacggaagccggacugcuguuuuucgucucccucuuucuugagaaaagggaugccaucuggaugcaaaagaagauccgaggcuucaaggguggcaccgaaaccuaccagcagaugaccaacgaagucuucugccggagccggaucucccugccgaagcucaaacuggagagccugcgcacggacgacuggaugcugcucgauaugcugaacgaacugguucgcugucccaagccguuguacgaucgucuucgcgaagacgauagagcguguuucagagugcccgucgauauucugcccgaugaggacgauacggacggugggggagaagaccccuucaaaaacacgcuggucaggcaucaggaucgcuuccccuacuucgccuugcgauacuucgaucugaagaaagucuucacuucccuccgcuuccauauagauuugggcaccuaccacuucgccauauacaagaagaugaucggcgagcagccggaagaccgccaucugacgcgcaaccuguacggcuucggccgaauacaggauuucgccgaggagcauagacccgaagaguggaagcguuuggugcgggauuuggacuacuucgagaccggcgacaagcccuauaucucccaaaccacuccgcacuaucauaucgagaaaggcaagaucgggcugagguucgugccggaagggcagcaucuuuggccgucgccggagguaggaacgacccgaacggggcgaagcaaauacgcccaagacaaacggcucacggcagaagcauuccugagcgugcaugagcugaugcccaugauguucuacuacuuccugcugagggagaaguauuccgaggagguaagugccgagaaggugcaaggaagaaucaagagggugauagaggauguguacgcuauauacgaugcuuucgcccgagacgaaaucaauacgcucaaggaguuggaugccuguuuggcggacaaggguauucggcgaggacaucuccccaagcaaaugaucggcauauugucccaagagcguaaggauauggaggagaaaguccgcaagaaacuucaggaaaugauagcggauacggaucaccgucuggauaugcuggaucggcagaccgaccgaaagaucaggaucggccgaaagaaugcuggccugcccaagucgggcgucauagccgacuggcugguacgggauaugaugcgcuuucagcccguggcgaaagacacgagcggcaagccccugaacaauagcaaggccaacagcaccgaauaccggaugcuacagcgcgcccucgcccuuuucgguggagagaaggaacgucugaccccguauuuccgccagaugaaucugacgggagggaacaauccccauccuuuccugcacgagacccggugggagagccauaccaauauccuguccuucuaucgcagcuaucugagagcaagaaaggcuuuccucgaacgcauagggcgaagcgaucggguggagaauugccccuuccuccugcucaaggaacccaaaacugaucggcagacauugguggcaggcuggaagggcgaauuucaucugccacgcgggauuuuuaccgaagcggucagagacugccugauagagaugggguacgaugaagucgggucauacagggaagucggauucauggccaaagccguuccgcuguauuucgagcgggcuugugaagaccggguacagccuuucuaugacagccccuucaauguaggcaacagccucaagcccaagaaaggacgcuuccugagcaaagaagaccgagccgaagagugggagagagguaaggagcgguuccgagaccuugaggcuuggucgcacagugcugcucgucggauaaaagaugcuuuugccggaaucgaguaugcaaguccgggaaauaagaagaaaaucgaacagcuguugcgggaucucucccuuugggaagccuuugagagcaagcugaaagucagggcagacaagaucaaucucgccaaacugaaaaaggaaauacucgaagcccaagaacaccccuaucacgacuucaagucguggcagaaguucgagcgcgaacugcgacuugucaagaaucaggauauuaucacuuggaugaugugccgggaucucauggaagagaacaagguggagggauuggauaccgguacucucuaccugaaagauauucggcccaacguccaagagcaggggagccucaaugugcugaaccgcgugaagccgaugcgcuugccuguggucguguacagagccgacagccggggccaugugcacaaggaggaggcuccucuggcgacggucuauaucgaagagagggacaccaagcugcugaagcagggcaauuucaaauccuuugucaaggaucgccggcucaacggccuuuucucuuucgucgauaccggcggacucgcgauggagcaguacccgaucagcaagcucaggguggaguacgagcuggccaaguaucagacggcaagggucugugucuucgagcugacgcucaggcuggaagagagucugcugagccgguauccucacuugccggaugagagcuucagagagaugcucgaaagcuggucggauccucucuuggccaaguggccggagcugcacgggaaaguccggcuucugaucgcugugcgcaaugccuucucgcacaaucaguaucccauguacgaugaggccgucuuuucguccauucggaaguacgaccccucuucccccgaugccauagaggaaaggauggggcugaacaucgcgcaccgguugagcgaggaagugaagcaggcaaaagaaacgguagaacgaaucauacaagcauaa

SEQ ID NO: 11095 - RNA, 3375 nt, Artificial Sequence
  Cas13b variant__Prevotella aurantiaca__WP_025000926.1__Cas13b
auggaagacgacaagaaaaccacaggcucaauuagcuacgaguuaaaagauaagcauuuuugggcggcguuccuuaauuuggcacgccacaaugucuauauuacaaucaaccauauuaacaagcuacuggaaauacgagaaaucgacaaugacgagaagguauuagauaucaaaacucuuuggcaaaaagguaauaaagaccuuaaucagaaagcucgguuaagagaacugaugacaaaacacuucccauucuuggaaacugcaauauacaccaaaaacaaagaagauaagaaagaaguaaaacaagaaaaacaagccgaagcacaaucacuugaaagccuaaaggauuguuuauuccucuuuuuagacaagcuucaagaagcaagaaacuauuauucucauuacaaguauucugaauuuucaaaagagccagaguuugaggaaggauuauuggaaaagauguauaauaucuuuggcaacaauauccaguuagugauaaaugauuaccaacauaacaaagauauuaacccugacgaagacuuuaaacaucuugacagaaaaggacaauucaaauacucuuuugcagauaacgaaggaaacauaacugaaagcgguuugcucuucuuuguuuccuuauuccuugaaaagaaagaugcaauauggaugcagcaaaagcuuaauggcuuuaaagacaaucuagaaaacaaaaagaaaaugacccacgagguauuuugcagaagccgaauacucaugccaaaacuucgauuggaaagcacgcaaacacaagauuggauuuugcucgauaugcucaacgaacugauucguugcccuaaaucguuguaugaacgccugcaaggagaugacagagaaaaguucaaaguccccuucgaccccgcagacgaggacuacaaugcagagcaagagccuuucaaaaacacauugauaaggcaccaagaucguuucccuuacuuuguauugcguuauuucgacuauaacgagauauucaaaaaucuucguuuccaaauagauuuaggcaccuaucacuucucuauuuauaagaaacuaauugguggucaaaaagaagaccgccaccuuacgcauaaacuuuaugguuuugaacgcauacaagaguucgccaaacagaaucgccccgaugaauggaaagcaaucguaaaagacuuagauacuuacgaaacuucaaacaaacgauauaucucggaaaccacaccccauuaucauuuggagaaccaaaagauuggcauuagguuuaggaaugguaacaaggaaauuuggccaucgcucaaaacaaaugacgaaaauaaugaaaaaagcaaguauaaacuugauaagcaauaccaagcagaagcuuucuugagcguacacgaacuuuugccaaugauguucuacuaucuguuguuaaagaaggaaaagccuaauaaugacgagauaaacgcaaguauaguagaaggcuuuaucaaaagagaaaucagaaauauauuuaaacucuaugaugcuuuugccaauggugagauaaacaacauagacgauuuagaaaaauacugugcggacaaaggaauccccaaaagacaucugcccaaacagaugguugccauuuuguacgacgagcauaaagauaugguaaaagaggcgaaacgcaagcaaaaggaaaugguaaaggauaccaagaaacugcuugcuacucuugaaaaacaaacacaaaaagaaaaagaagaugacggaagaaauguaaaacucuugaaaucuggcgagauugccagauggcugguaaaugauaugaugcgcuuucagccuguucaaaaagacaaugaggguaaaccacuuaacaauaguaaagccaacagcacagaauaucaaaugcugcaacgcucccuugcgcuuuauaauaaugaagaaaaacccacucguuacuucagacaaguuaaucucauagaaaguaacaauccccacccuuucuuaaaauggacgaagugggaagaauguaauaauaucuuaacauucuauuauaguuaucugacaaaaaagauagaauuucuaaauaagcuaaagccugaagauuggaagaagaaccaauauuuccuuaagcuuaaagagccaaagaccaaccgagaaacauuggugcaaggguggaagaauggcuuuaaucugccacgugguaucuuuacagaaccuaucagagaaugguuuaaaaggcaucagaacaauucuaaggaauacgagaaagucgaagcccucgacagagucggcuugguuacaaagguaauacccuuguucuucaaagaagaauauuuuaaagacaaagaagaaaauuuuaaagaagauacccaaaaagaaauuaacgacugcguacagccauuuuacaacuuuccuuacaaugugggcaauauacacaaacccaaagaaaaggauuucuuacaucgugaggaacguauagaacugugggauaaaaagaaagacaaguucaaggguuauaaagaaaaaauaaaguccaagaaguugacggaaaaggauaaagaagaauuucguucuuaucuugaauuucaaucuuggaauaaguucgagcgagaauuacgacuuguacgaaaccaagacaucguaacguggcuguuguguaaggaacugauugauaaacugaaaauagacgaacucaauauugaagaauugaaaaagcuacgcuuaaauaauauugauacagacacagcaaaaaaggaaaagaacaauauucugaacagaguaaugccgauggaacuaccuguuacgguguacgaaauugacgauucccacaaaauaguaaaggauaaaccuuugcauaccauuuauauaaaagaggcugaaaccaagcuuuuaaaacaaggaaacuucaaagcuuugguaaaagaccgcagacuuaaugguuuauucucguucguuaaaacuaacucugaagcagaaucgaagagaaauccuaucaguaaguuacguguagaauaugaacucggagaauaucaagaagcaagaauagaaauuauccaagauauguuggcguuagaagaaaagcugauaaauaaauauaaagauuugccaaccaacaaguucagugaaaugcuuaauaguugguuggaggguaaagacgaggcagacaaagcaagguuucaaaaugauguagacuuucuuauugcuguacgaaaugccuuuucacacaaccaauacccaaugcacaacaaaauagaauucgcaaauauuaagccauucagucuuuauacagcgaauaauucggaagaaaaaggacuugguauugccaaucagcuaaaggauaaaaccaaagaaacaacagacaaaauaaaaaaaauagaaaagccaauagaaacuaaagaauaa

SEQ ID NO: 11096 - RNA, 3384 nt, Artificial Sequence; identical to SEQ ID NO: 11046
  Cas13b variant__Prevotella buccae__EFU31981.1__Cas13b

SEQ ID NO: 11097 - RNA, 3384 nt, Artificial Sequence
  Cas13b variant__Prevotella buccae__WP_004343581.1__Cas13b
augcaaaaacaagauaaauuauuuguagauagaaagaaaaaugcuauauuugccuuuccuaaauauauaacaauaauggaaaaccaagagaaaccugaaccaauuuauuaugaauugacagauaagcauuucugggcugccuuucuuaacuuggcgcgccacaaugucuauaccaccauuaaucacaucaacagacguuuggaaauagcagagcuaaaagacgauggauauaugauggacauuaaaggcaguuggaacgaacaagcgaaaaaacucgacaaaaaaguucggcugagagacuugaucaugaaacacuuuccuuuucuggaagcugcagcuuaugaaauaacaaacucuaaaagucccaacaauaaggagcaacgggaaaaggaacaauccgaagcccuaucacuuaacaacuugaagaauguucuauucauuuucuuggaaaaacuucagguucucaggaacuacuacucccauuacaaguauucugaagaauccccaaaaccgauauuugaaacaagccuuuugaaaaacauguauaagguuuucgaugccaaugugcgguuaguaaagagagacuauaugcaucaugagaauauagacaugcaaagagauuuuacacaucucaacaggaaaaaacaagugggacgaacaaaaaacaucauagacaguccuaacuuucauuaccauuuugcagauaaagaaggcaauaugaccauagcaggcuuacuguucuucgucucuuuauuucuugauaaaaaagacgcuauuuggaugcagaaaaagcuaaagggauuuaaagauggcagaaacuugcgugagcaaaugacaaacgaaguauuuugcagaagccguauaucuuugccuaagcuaaaauuggagaauguacagacaaaagacuggaugcaacuugauaugcuuaacgaauugguucgcugucccaaaucgcuguaugaacgguuacgagaaaaagauagggaaaguuuuaaaguaccuuucgauauuuucucugacgacuaugaugcugaagaagaaccauuuaagaacacgcuuguaaggcaucaagaccgcuuuccauauuuugucuugagauauuucgauuuaaaugagauauucgaacaacuccgcuuccaaauagauuuagguaccuaucauuucucuaucuauaacaaacgaaucggugaugaggaugaaguucgccaucucacccaucaucuguaugguuuugcgcgcauacaagacuuugcacagcaaaaccaacccgaaguguggaggaaauuaguaaaagacuuagauuauuucgaggcaucgcaagagccuuacauaccuaagacugcuccacauuaccauuuagagaaugaaaagauaggcauuaaguuuugcaguacccacaacaaccucuuuccaucucucaaaacagaaaagacaugcaauggaagaaguaaauuuaaucucggaacacaauuuacggcagaagcauuuuuaaguguccacgaauuguugccgaugauguuuuauuaucuguuauugaccaaggauuacuccagaaaagaaagcgcagacaaaguagagggaauuauaagaaaagaaauaagcaacauauacgcuaucuacgaugcuuuugccaauggugagauaaauagcauugcagaccuaaccugccgacuucaaaaaacaaauauacuacaaggccauuugccaaagcaaaugauuuccauauuggaaggcagacaaaaagauauggaaaaagaggcugagcgcaagauuggggaaaugauagacgacacccaaagaagacuugacuugcucugcaagcagacaaaucagaagauaaggauuggcaaaaggaaugccggucugcuaaaaucgggaaaaauugcagauugguugguaaaugacaugaugcgcuuccaaccuguucaaaaagaccaaaauaacauuccaauaaacaauagcaaggcuaacagcaccgaauaucgaaugcuucagcgugcgcuugcccuuuucggcagugagaacuuccgccuuaaggcauauuuuaaucaaaugaaucuuguggggaaugacaauccgcauccuuuccuugcagaaacacaaugggaacaucaaacuaacauucugucuuucuaccgaaacuauuuggaagcgaggaaaaaguaucuuaagggcuuaaaaccacaaaacuggaaacaauaucagcauuuucucauacuuaaaguacagaagaccaaccgcaacacauuaguuacaggauggaaaaacaguuucaaucucccccguggaauauuuacccaaccaauaagggaaugguuugagaaacauaauaauucaaaaagaauauacgaccaaauacuaucuuuugaccgaguaggauuuguugcaaaagcuauucccuuauacuuugcagaagaauauaaagacaauguacagccuuucuacgauuauccguucaauaucggcaacaaacuuaaaccccaaaaagggcaauucuuagauaaaaaagagcgugucgaauuguggcaaaagaauaaagagcuauucaaaaauuauccgucugaaaagaaaaagacagacuuagcuuaucuugauuuccuaucauggaaaaaguuugaacgcgaacugcgacuuaucaagaaucaggauaucgucacaugguugauguucaaagaacuauucaauauggcuacuguggaaggauugaagauuggagaaauacaucugagggacauugauacaaacacggcaaaugaggaaagcaacaauauucuaaauagaaucaugcccaugaaguugccuguuaaaacauacgaaacagacaauaaaggaaauauauuaaaggaaagaccuuuagcaaccuuuuauaucgaagaaacggaaaccaaaguccugaaacagggcaauuucaaaguauuggcaaaagaccgcaggcucaacggacuacuuucuuuugcagaaacuacagacauugauuuagaaaaaaauccuaucaccaaauugaguguagaccaugagcuuauaaaauaucagacuacaaggauuaguaucuuugagaugacauuaggacuggaaaagaaacucauaaacaaauaucccacacuaccuacagauagcuucagaaauaugcuugaaaggugguugcagugcaaagcuaauagaccggaauuaaagaauuacguuaauaguuugauugcagugagaaaugcuuuuucccacaaccaguaucccauguaugaugccacacucuuugcugaaguuaaaaaauuuacccuuuucccuucugucgauacaaaaaagauugagcuaaauauagcgccacaguuacuggaaauaguaggaaaagccauaaaagaaauugaaaaaucagaaaauaaaaacuaa

SEQ ID NO: 11098 - RNA, 3402 nt, Artificial Sequence
  Cas13b variant__Prevotella falsenii__WP_036884929.1__Cas13b
augaaaaacgauaauaacucuacaaaaucaacugacuauacguuaggugauaagcauuuuugggcggcauuccuuaauuuggcacgccacaaugucuauauuacagugaaccauauuaacaaggugcuggagcuaaaaaacaagaaagaccaagaaauaauuauugauaaugaccaagacauauuagccauuaaaacucuuuggggaaaaguugauacagauauuaauaagaaagaccgauuaagagaacugauaaugaaacauuucccuuucuuggaagcugcgacauaucaacagaguucuaccaauaauacaaaacaaaaagaagaagaacaagccaaagcccaaucguuugaaagucugaaggauuguuuauuucucuuuuuagagaaacuucgggaagcaagaaacuauuauucucauuacaagcauucuaaaucuuuagaagaaccaaaguuggaggaaaaauuacuggaaaauauguauaauaucuuugauaccaauguucaauuagugauaaaagauuacgaacauaacaaagauauaaacccugaagaagacuuuaagcaucuuggcagagcagaaggagaauucaauuauuauuuuacaagaaauaaaaaaggaaacauaaccgaaagcgguuugcucuucuuuguauccuuauuccuugaaaagaaagaugcaauaugggcacagacaaagauuaaaggcuuuaaagacaauagggaaaacaaacagaaaaugacccaugagguauuuugcaggagccgaaugcucuugccaaaacugcgauuggaaagcacgcaaacacaagacuggauauugcucgauaugcucaacgagcugauacguugccccaaaucguuguacaaacgccugcaaggagagaagagagaaaaguucagaguccccuucgauccugcagacgaggacuacgaugccgaacaagagccuuucaaaaacacauugguaaggcaccaagaccguuucccuuacuuugcauugcgcuauuucgacuauaacgagauauucacaaaucuucguuuccaaauagacuugggcaccuaucacuucuccauuuauaagaaacaaaucggugauaagaaggaagaccgccaucuuacacauaagcuauaugguuuugaacgcauacaagaauuugccaaagagaaucgacccgaugaguggaaagcacuuguaaaggauuuagauaccuuugaagaaucaaacgaaccguauaucucggaaaccacaccgcauuaucauuuggagaaccaaaagauaggcauuagaaauaagaauaagaaaaagaaaaaaacuauuuggccaucacuugaaacaaaaacaacggucaaugaaagaaguaaguacaaucuugguaaaucauucaaggcagaggcauuccuaagcguacacgagcuauugccaaugauguucuauuaucuguuguuaaauaaagaagaaccuaacaauggaaagauaaaugcaaguaaaguggaagguaucauugagaaaaaaauaagagauauauauaaacucuauggugcuuuugccaaugaagagauaaacaacgaagaagaauuaaaagaauacugugagggcaaagauauugcaauacgacaucugcccaaacaaaugauugccauauugaaaaacgaguauaaagauauggcaaaaaaggcagaagacaagcaaaagaaaaugauaaaggacaccaagaagcgucuugcagcucuugauaaacaaguaaagggagagguagaagaugguggacgaaauaucaaaccguugaaaucagguaggauugccaguugguugguaaaugauaugaugcguuuccaaccuguacaaagagauagagacgguuauccacugaacaacaguaaagccaacagcacagaauaucagcuguugcagcgcacgcuugcacucuucggcagcgaacgugaacgccuugcuccuuacuucagacaaaugaaucucauaggaaaagacaacccacacccauucuugaaagauaccaaguggaaggaacauaacaauaucuugucuuucuaucgcagcuauuuggaagcaaagaaaaacuuucucggaagucuaaagcccgaagauuggaagaagaaccaauauuuccuuaagcuuaaagagccaaagaccaaucgcgaaacauuggugcaaggguggaaaaacggcuuuaaucugccacguggaaucuuuacagagccuaucagagaaugguuuauaaggcaucagaaugaaucagaggaauacaagaaaguuaaagacuucgauagaauuggcuugguugcaaaaguaauucccuuguucuucaaagaagauuaccaaaaagaaauagaagacuauguacagccauuuuauggcuauccuuucaacgugggcaauauacacaacucccaagaagguacauucuugaauaaaaaggaacgugaagaacuguggaaaggaaauaaaaccaaguucaaagauuauaaaaccaaagagaaaaacaaggaaaagacgaauaaggauaaguucaagaagaagacagaugaggaaaaggaagaguuccguucuuaucuugauuuucaaucuuggaaaaaguuugagcgggaacuacgacuuguacgaaaccaagacaucguaacguggcuguuguguauggaacugauugauaagcugaaaauagacgaacucaauaucgaagaacugcaaaaguugcgcuuaaaggauauugauacagauacagcaaaaaaagaaaagaauaauauucugaacagaauaaugccgauggaacugccuguuacgguguacgaaacugacgauuccaacaauauaauaaaggauaaaccuuugcauaccauuuauauaaaagaggcugaaaccaagcuuuuaaaacaaggaaacuuuaaggcauugguaaaagaccgcaggcucaaugggcuguucucguucguugaaacuucuucugaagcagaauugaagaguaaaccuaucagcaaaucgcuuguagaauaugaacucggagaguaucaaagggcaagagucgaaauuaucaaagauauguugagauuagaagaaacgcugauaggcaacgaugagaaguuaccaaccaacaaguucagacaaaugcuugauaagugguuggagcacaagaaagaaacggacgauacagauuugaagaaugacguaaaacuccuuacugaggugcggaaugccuuuucgcacaaucaauacccaaugcgcgauagaauagcauucgcaaauauuaaaccauucagccuuucuucugcuaauacuuccaacgaggagggacuugguauugccaagaaacugaaggauaaaaccaaagaaacaauagacagaauaauagaaauagaagaacaaacagcaacuaaaagauaa

SEQ ID NO: 11099 - RNA, 3402 nt, Artificial Sequence
  Cas13b variant__Prevotella intermedia__BAU18623.1__Cas13b
auggaagacgacaagaaaaccacagauucaauuagcuacgaguuaaaagauaagcauuuuugggcggcguuccuuaauuuggcacgccacaaugucuauauuacagugaaccacauuaacaagguacuggagcuaaaaaacaagaaagaccaagacauaauuauugauaaugaccaagacauauuggccauuaaaacucauugggaaaaaguuaauggagaccuuaauaagacagagcgacuaagagaacugaugacaaaacacuucccauucuuggaaacugcaauauacagcaaaaacaaagaagauaaggaagaaguaaaacaagaaaaacaagccaaagcccaaucguuugacagucugaagcauugcuuauuucucuuuuuagagaagcuucaagaaacaagaaacuauuauucucauuacaaguauucugaaucuacaaaagagccaauguuagagaaagaauuacugaaaaagauguauaauaucuuugacgacaauauccaguuagugauaaaagauuaccaacauaacaaagauauaaaucccgacgaagacuucaagcaucuugacagaacagaagaagauuucaauuauuauuuuacaagaaauaaaaaaggaaacauaacugaaagcggcuugcucuucuucguuuccuuauuccuugaaaagaaagaugcaauauggaugcagcaaaagcuuagaggcuuuaaagacaauagggaaagcaaaaagaaaaugacccacgagguuuuuugcaggagccgaaugcucuugccaaaacuacgauuggaaagcacgcaaacacaagacuggauauugcucgauaugcucaacgagcugauacguugccccaaaucgcuguacgaacgccuacaaggagaggacagagaaaaguucaaaguccccuucgaccccgcagacgaagacuacgaugcagagcaagagccuuucaaaaacaccuugguaaggcaccaagaccguuucccuuacuuugcauugcgcuauuucgacuauaacgagauauucacaaaucuucguuuccaaauagacuugggcaccuuucacuucucuauuuauaagaaacuaaucgguggucaaaaggaagaccgccaccuuacgcauaagcuauacgguuuugaacgcauacaagaguuugccaaacagaaucgccccgaugaguggaaagcaaucguaaaggacuuagauacuuacgaaacuucaaacgaacgauauaucucggaaaccacaccgcauuaucauuuggaaaaccaaaagauaggcauuagguuuaggaaugauaacgaugaaauuuggccaucgcucaaaacaaauggcgaaaauaaugaaaaaagcaaguauaaacuugauaaacaauaccaagcagaagcuuucuugagcguacacgagcuauugccaaugauguucuacuaucuguuguuaaagaaggaagaaccuaauaaugacaagaaaaacgcaaguauaguagaaggcuuuaucaaaagagaaaucagagacauguauaaacucuacgaugcuuuugccaauggugagauaaacaacauagacgauuuagaaaaauacugugaggacaaaggaauccccaaaagacaucugcccaaacagaugguugccauuuuguacgacgagcauaaagauaugguaaaagaggcgaaacgcaagcaaaggaaaaugguaaaggauacagagaaacugcuugcugcucuugaaaaacaaacacaagaaaaaacagaagaugguggaagaaauaucagacugcugaagucuggcgagauugccagauggcugguaaacgauaugaugcguuuccaaccuguucaaaaagacaaugagggcaauccacugaacaacaguaaagccaacagcacagaauaucagaugcugcaacgcucgcuugcgcuuuacaacaaggaagaaaaaccuacucguuacuucagacaaguaaaccucauaaauagcagcaauccccacccauuccuaaaauggacgaagugggaagaaugcaacaacaucuugucuuucuaucgcaguuaccuaacgaaaaagauagaauuucugaauaaacuaaagccugaagauugggagaagaaccaauacuuccuuaagcuuaaagagccaaagaccaaccgcgaaacauuggugcaaggguggaagaacggcuuuaaucugccacgugguaucuuuacagaaccuaucagagaaugguuuaaaaggcaucagaacgauucuaaggaauacgagaaaguugaagcccucgacagaguuggcuugguuacaaagguaauacccuuguucuucaaaaaagaagauucuaaagacaaagaagaagauuuaaaaaaagaugcccaaaaagaaauuaacaacugcgugcagccauucuacagcuucccuuacaacgugggcaauauacacaaacccgacgaaaaggauuucuuacaucgugaggaacguauagaacugugggauaaaaagaaagacaaguucaaggguuauaaagccaaaguaaaguccaagaaguugacggacaaggaaaaagaagaauaucguucuuaucucgaauuucaaucuuggaacaaguuugagcgggaacuacgacuuguacgaaaccaagacaucguaacguggcuguuguguacggaacugauugauaagcugaaaguggagggacugaacgucgaagaacugaaaaagcuacgcuuaaaggauauugacacagacacagcaaaacaagaaaagaacaauauucugaacagaguaaugccgaugcagcuaccuguuacgguguacgaaauugacgauucccacaauauaguaaaggacagaccuuugcauacuguuuacaucgaagaaacuaaaaccaagcuuuuaaaacaaggaaacuucaaggcuuugguaaaagaccgcaggcucaauggucuguucucguucguugauacuucuucugaagcagaguugaagaguaacccuaucagcaaaucgcuuguagaauacgaacucggagaguaucaaaacgcaagaauagaaacuauuaaagauauguuguuguuagaagaaacacugauugaaaaauauaaaaacuugccaaccgacaacuucagugauaugcuaaaugguugguuggagggcaaagacgaggcagacaaagcaagguuucagaacgauguaaaacuccuuguugccguacggaaugccuuuucgcacaaccaauacccaaugcgcaauagaauagcauucgcaaacauuaauccauucagccuuucuucugcugauacuucugaagaaaagaaacuugauauugccaaucagcugaaggauaaaacccacaaaauaauaaaaagaauuauagaaauagaaaagccaauagaaacuaaagaauaa

SEQ ID NO: 11100 - RNA, 3405 nt, Artificial Sequence
  Cas13b variant__Prevotella intermedia__AFJ07523.1__Cas13b
augaaaauggaagacgacaagaaaaccaaagaaucaacuaacauguuagacaacaagcauuuuugggcggcguuccuuaauuuggcacgccacaaugucuauauuacagugaaccacauuaacaagguacuggagcuaaaaaacaagaaagaccaagacauaauuauugauaaugaccaagacauauuggccauuaaaacucauugggaaaaaguuaauggggaccuuaauaagacagagcgauuaagagaacugaugacaaaacacuucccauucuuggaaacugcaauauacaccaaaaacaaagaagauaaggaagaaguaaaacaagaaaaacaagccaaagcccaaucguuugacagucugaagcauuguuuauuucucuuuuuagagaagcuucaagaagcaagaaacuauuauucucauuacaaguauucugaaucuacaaaagagccaauguuagagaaagaauuacugaaaaagauguauaauaucuuugacgacaauauccaguuagugauaaaagauuaccaacauaacaaagauauaaaucccgacgaagacuucaagcaucuugacagaacagaagaagaauucaauuauuauuuuacaacaaauaaaaaaggaaacauaaccgcaagcgguuugcucuucuucguuuccuuauuccuugaaaagaaagaugcaauauggaugcagcaaaagcuuagaggcuuuaaggacaauagggaaagcaaaaagaagaugacccacgagguauuuugcaggagccgaaugcucuugccaaaacuacgauuggaaagcacgcaaacacaagacuggauauugcucgauaugcucaacgagcugauacguugccccaaaucgcuguacgaacgccugcaaggagaauacagaaaaaaguucaauguccccuucgacucugcagacgaagacuacgaugcagagcaagagccuuucaaaaacacauugguaaggcaccaagaccguuucccuuacuuugcauugcgcuauuucgacuauaacgagauauucacaaaucuucguuuccaaauagacuugggcaccuaucacuucuccauuuauaagaaacuaaucgguggucaaaaggaagaccgccaccuuacacauaagcuguaugguuuugaacgcauacaagaguuugccaaacaaaaucgcaccgaugaguggaaagcuaucguaaaggauuuugacacuuacgaaacuucagaagaaccauauaucucggaaaccgcaccgcauuaucauuuggagaaccaaaagauugguauuagguuuaggaaugauaacgaugaaauuuggccaucgcucaaaacaaauggcgaaaauaaugaaaaacgcaaguauaaacuugauaagcaauaccaagcagaggcuuuccuaagcguacacgagcuacugccaaugauguucuacuaucuguuguuaaagaaggaagaaccuaauaaugacaagaaaaacgcaaguauaguagaaggcuuuauuaaaagagaaaucagagauauauauaaacucuaugaugcuuuugccaauggugagauaaacaacauagacgauuuagaaaaauacugugaggacaaaggaauccccaaaagacaucugcccaaacagaugguugccauuuuguacgacgagcauaaagauauggcagaagaggcgaaacgcaagcaaaaggaaaugguaaaggauaccaagaaacugcuugcuacucuugaaaaacaaacacaaggagaaauagaagaugguggaagaaauaucagacugcugaagucuggcgagauugccagauggcugguaaacgauaugaugcguuuccaaccuguucaaaaagacaaugagggcaauccacugaacaacaguaaagccaacagcacagaauaucagaugcugcaacgcucgcuugcgcuuuacaacaaggaagaaaaaccuacucguuacuucagacaaguaaaccuuauaaauagcagcaauccccacccuuuccuaaaauggacgaagugggaagaaugcaacaacaucuugucuuucuaucgcaguuaccuaacgaaaaagauagaauuucugaauaaacuaaagccugaagauugggagaagaaccaauacuuccuuaagcuuaaagagccaaagaccaaccgcgaaacauuagugcaaggguggaagaacggcuuuaaucugccacgugguaucuuuacagaaccuaucagagaaugguuuaaaagacaucagaacgauucugaggaauacgagaaaguugaaacccucgacagaguuggcuugguuacaaagguaauacccuuguucuucaaaaaagaagauucuaaagacaaagaagaauauuuaaaaaaagaugcccaaaaagaaauuaacaacugcguacagccauucuacggcuucccuuacaacgugggcaauauacacaaacccgacgaaaaggauuucuuaccuucugaggaacgcaaaaaacuauggggugauaagaaauacaaguucaaggguuauaaagccaaaguaaaguccaagaaguugacggacaaggaaaaagaagaauaucguucuuaucucgaauuucaaucuuggaacaaguuugagcgggagcuacgacuugugcgaaaccaagacaucguaacguggcuguuguguacggaacugauugauaagcugaaaguggagggacugaacgucgaagaacugaaaaagcuacgcuuaaaggauauugacacagacacagcaaaacaagaaaagaacaauauucugaacagaguaaugccgaugcagcuaccuguuacgguguacgaaauugacgauucccacaauauaguaaaggauagaccuuugcauacuguuuacaucgaagaaacuaaaaccaagcuuuuaaaacaaggaaacuucaaggcuuugguaaaagaccgcaggcucaauggucuguucucguucguugauacuucuucugaaacagaguugaagaguaacccuaucagcaaaucgcuuguagaauacgaacucggagaguaucaaaacgcaagaauagaaacuauuaaagauauguuguuguuagaagaaacacugauugaaaaauauaaaaccuugccaaccgacaacuucagugauaugcuuaaugguugguuggaggguaaagacgaggcagacaaagcaagguuucagaacgauguaaaacuccuuguugccguacggaaugccuuuucgcacaaccaauacccaaugcgcaauagaauagcauucgcaaacauuaauccauucagccuuucuucugcugauacuucugaagaaaagaaacuugauauugccaaucagcugaaggauaaaacccacaaaauaauaaaaagaauuauagaaauagaaaagccaauagaaacuaaagaauaa

SEQ ID NO: 11101 - RNA, 3399 nt, Artificial Sequence
  Cas13b variant__Prevotella intermedia__WP_014708441.1__Cas13b
auggaagacgacaagaaaaccaaagaaucaacuaacauguuagacaacaagcauuuuugggcggcguuccuuaauuuggcacgccacaaugucuauauuacagugaaccacauuaacaagguacuggagcuaaaaaacaagaaagaccaagacauaauuauugauaaugaccaagacauauuggccauuaaaacucauugggaaaaaguuaauggggaccuuaauaagacagagcgauuaagagaacugaugacaaaacacuucccauucuuggaaacugcaauauacaccaaaaacaaagaagauaaggaagaaguaaaacaagaaaaacaagccaaagcccaaucguuugacagucugaagcauuguuuauuucucuuuuuagagaagcuucaagaagcaagaaacuauuauucucauuacaaguauucugaaucuacaaaagagccaauguuagagaaagaauuacugaaaaagauguauaauaucuuugacgacaauauccaguuagugauaaaagauuaccaacauaacaaagauauaaaucccgacgaagacuucaagcaucuugacagaacagaagaagaauucaauuauuauuuuacaacaaauaaaaaaggaaacauaaccgcaagcgguuugcucuucuucguuuccuuauuccuugaaaagaaagaugcaauauggaugcagcaaaagcuuagaggcuuuaaggacaauagggaaagcaaaaagaagaugacccacgagguauuuugcaggagccgaaugcucuugccaaaacuacgauuggaaagcacgcaaacacaagacuggauauugcucgauaugcucaacgagcugauacguugccccaaaucgcuguacgaacgccugcaaggagaauacagaaaaaaguucaauguccccuucgacucugcagacgaagacuacgaugcagagcaagagccuuucaaaaacacauugguaaggcaccaagaccguuucccuuacuuugcauugcgcuauuucgacuauaacgagauauucacaaaucuucguuuccaaauagacuugggcaccuaucacuucuccauuuauaagaaacuaaucgguggucaaaaggaagaccgccaccuuacacauaagcuguaugguuuugaacgcauacaagaguuugccaaacaaaaucgcaccgaugaguggaaagcuaucguaaaggauuuugacacuuacgaaacuucagaagaaccauauaucucggaaaccgcaccgcauuaucauuuggagaaccaaaagauugguauuagguuuaggaaugauaacgaugaaauuuggccaucgcucaaaacaaauggcgaaaauaaugaaaaacgcaaguauaaacuugauaagcaauaccaagcagaggcuuuccuaagcguacacgagcuacugccaaugauguucuacuaucuguuguuaaagaaggaagaaccuaauaaugacaagaaaaacgcaaguauaguagaaggcuuuauuaaaagagaaaucagagauauauauaaacucuaugaugcuuuugccaauggugagauaaacaacauagacgauuuagaaaaauacugugaggacaaaggaauccccaaaagacaucugcccaaacagaugguugccauuuuguacgacgagcauaaagauauggcagaagaggcgaaacgcaagcaaaaggaaaugguaaaggauaccaagaaacugcuugcuacucuugaaaaacaaacacaaggagaaauagaagaugguggaagaaauaucagacugcugaagucuggcgagauugccagauggcugguaaacgauaugaugcguuuccaaccuguucaaaaagacaaugagggcaauccacugaacaacaguaaagccaacagcacagaauaucagaugcugcaacgcucgcuugcgcuuuacaacaaggaagaaaaaccuacucguuacuucagacaaguaaaccuuauaaauagcagcaauccccacccuuuccuaaaauggacgaagugggaagaaugcaacaacaucuugucuuucuaucgcaguuaccuaacgaaaaagauagaauuucugaauaaacuaaagccugaagauugggagaagaaccaauacuuccuuaagcuuaaagagccaaagaccaaccgcgaaacauuagugcaaggguggaagaacggcuuuaaucugccacgugguaucuuuacagaaccuaucagagaaugguuuaaaagacaucagaacgauucugaggaauacgagaaaguugaaacccucgacagaguuggcuugguuacaaagguaauacccuuguucuucaaaaaagaagauucuaaagacaaagaagaauauuuaaaaaaagaugcccaaaaagaaauuaacaacugcguacagccauucuacggcuucccuuacaacgugggcaauauacacaaacccgacgaaaaggauuucuuaccuucugaggaacgcaaaaaacuauggggugauaagaaauacaaguucaaggguuauaaagccaaaguaaaguccaagaaguugacggacaaggaaaaagaagaauaucguucuuaucucgaauuucaaucuuggaacaaguuugagcgggagcuacgacuugugcgaaaccaagacaucguaacguggcuguuguguacggaacugauugauaagcugaaaguggagggacugaacgucgaagaacugaaaaagcuacgcuuaaaggauauugacacagacacagcaaaacaagaaaagaacaauauucugaacagaguaaugccgaugcagcuaccuguuacgguguacgaaauugacgauucccacaauauaguaaaggauagaccuuugcauacuguuuacaucgaagaaacuaaaaccaagcuuuuaaaacaaggaaacuucaaggcuuugguaaaagaccgcaggcucaauggucuguucucguucguugauacuucuucugaaacagaguugaagaguaacccuaucagcaaaucgcuuguagaauacgaacucggagaguaucaaaacgcaagaauagaaacuauuaaagauauguuguuguuagaagaaacacugauugaaaaauauaaaaccuugccaaccgacaacuucagugauaugcuuaaugguugguuggaggguaaagacgaggcagacaaagcaagguuucagaacgauguaaaacuccuuguugccguacggaaugccuuuucgcacaaccaauacccaaugcgcaauagaauagcauucgcaaacauuaauccauucagccuuucuucugcugauacuucugaagaaaagaaacuugauauugccaaucagcugaaggauaaaacccacaaaauaauaaaaagaauuauagaaauagaaaagccaauagaaacuaaagaauaa

SEQ ID NO: 11102 - RNA, 3381 nt, Artificial Sequence
  Cas13b variant__Prevotella intermedia__WP_036860899.1__Cas13b
auggaagacgacaagaaaaccacagacucaauucgcuacgaguuaaaagauaagcauuuuugggcggcguuccuuaauuuggcacgccacaaugucuauauuacagugaaccacauuaacaagauacuggaagaaggcgaaaucaaccgugacggauacgaaacuacccuuaagaauacuuggaacgaaauuaaagauauuaauaagaaagaccgacuaagcaaacugauaauaaaacacuucccauucuuggaagcugcgacauaucgacugaauccuaccgauaccacaaaacaaaaagaagagaaacaagccgaagcccaaucucuugaaagucugagaaagucuuuuuuuguuuuuauauauaaacuucgagaccuaagaaaucauuauucccacuacaagcauucuaaaucuuuagaaagaccaaaguuugaggaaggauuauuggaaaagauguauaauaucuuuaacgcaaguauccgcuuaguaaaagaagauuaccaauauaacaaagauauaaacccugacgaagacuucaagcaucuugacagaacagaagaagaauucaauuauuauuuuacaaaagauaacgaaggaaacauaacugaaagugguuugcucuucuuuguauccuuauuccuugaaaagaaagaugcaauauggaugcagcaaaagcuuagaggcuuuaaagacaauagggaaaacaaaaagaaaaugaccaaugaaguguuuugcaggagccgaaugcucuugccaaaacuacgauugcaaagcacacaaacacaagacuggauauugcucgauaugcucaacgagcugauacguugccccaaaucgcuguacgaacgccugcgagaagaggacagagaaaaguucagaguucccaucgaaaucgcagacgaagacuacgacgcagagcaagagccuuucaaaaacacauugguaagacaccaagaccguuucccuuacuuugcauugcgcuauuucgacuauaacgagauauucacaaaucuucguuuccaaauagacuugggcaccuaucacuucuccauuuauaagaaacaaaucggugauuauaaagaaagccaucaucuuacgcauaagcuguaugguuuugaacgcauacaagaauuuaccaagcagaaucgccccgaugaauggagaaaauuuguaaagacuuucaacucuuucgaaacuucaaaagagccguauaucccagaaaccacaccgcauuaucauuuggagaaccaaaagauaggcauuagauuuaggaaugauaacgauaaaauuuggccaucgcucaaaacaaauagcgaaaagaaugaaaaaaguaaguauaaacuugauaaaucauuccaagcagaggcuuuccuaaguguacacgaacuauugccaaugauguucuacuaucuguuguuaaagacggaaaacacugauaaugacaaugaaauagaaacaaagaagaaagaaaauaaaaacgauaaacaggaaaaacauaagauagaagaaaucauugagaauaaaauaacagaaauauaugcucuuuacgauacuuuugccaauggugagauaaaaagcauagacgaguuagaagaauacuguaaaggcaaagauauugaaauaggacaucugcccaaacaaaugauugccauauugaaagaugagcauaaaguuauggcaacagaggcggaacgcaaacaagaagaaauguuaguugauguccaaaagagccuugaaucucuugauaaucaaauaaaugaagagauagaaaacguugaaagaaagaacagcucauugaaaucuggcaagauugccagcugguugguaaacgauaugaugcguuuucagccuguucaaaaagacaaugagggcaaaccacugaacaacaguaaagccaacagcacagaauaucagcuguugcaacguacgcuugcauucuucggcagcgaacacgaacgccuugccccuuacuucaaacaaacgaagcucauagagaguagcaacccucacccauucuugaaggauaccgagugggaaaagugcaacaauaucuugucuuucuaucgcagcuauuuggaagcaaagaaaaacuuucuugaaagucuaaagccagaagauugggagaagaaccaauacuuccuuaagcuuaaagagccaaagaccaagcccaaaacauuggugcaaggguggaagaacggcuuuaaucuaccacguggaaucuuuacggaacccauaaggaaaugguuuaugaagcaucgggaaaacauaacaguagccgaguuaaaaagaguuggcuugguugcaaaaguaauuccuuuguucuucagugaagaauauaaggacagcguacagccauuuuacaacuaucauuuuaacguugguaacauaaacaaacccgaugaaaagaauuucuuaaauugugaggaacguagagaacuauugcguaagaagaaagacgaguucaagaagaugacggacaaggaaaaagaagaaaacccuucuuaucucgaauuuaaaucuuggaauaaguuugaacgggagcuacgacuugugcgaaaccaagacaucguaacgugguuguuguguauggagcuguuuaauaaaaagaagauaaaggaacuaaacgucgaaaaaauauauuuaaagaauauuaauacaaauacaacaaaaaaagaaaaaaauacagaagaaaagaacggagaagaaaagaauauaaaggaaaagaacaauauucugaauaggauaaugccaaugcgauuaccuauuaaaguauaugggagagaaaacuucucuaagaacaaaaagaagaagauaagaaggaauacuuuuuuuaccguuuacauugaagaaaaaggaacuaaacucuuaaaacaaggcaacuucaaagcuuuggaaagagaccgcagauuggguggucuauucucguucguuaaaacuccuucuaaagcagaaucgaagaguaauacuaucaguaaauugcguguagaauaugaacucggagaguaucaaaaagcaagaauagaaauuaucaaagauauguuggcguuagaaaaaacgcugauagacaaauacaauagcuuggacaccgacaacuucaacaaaaugcuuacugauuggcuggaacucaaaggcgagccagacaaagcaaguuuccagaacgacguagaccuccuuauugccguacggaaugccuuuucgcacaaccaauacccaaugcgcaauagaauagcauucgcaaacauuaauccauucagccuuucuucugcuaauacuucugaagaaaagggacuugguauugccaaucagcugaaggauaaaacccacaaaacgauagaaaaaauaauagaaauagaaaagccaauagaaacuaaagaauaa

SEQ ID NO: 11103 - RNA, 3363 nt, Artificial Sequence
  Cas13b variant__Prevotella intermedia__WP_061868553.1__Cas13b
auggaagacgacaagaaaaccacagacucaauucgcuacgaguuaaaagauaagcauuuuugggcggcguuccuuaauuuggcacgccacaaugucuauauuacagugaaccauauuaacaagauacuggaagaagaugaaaucaaccgugacggauacgaaaauacccuugagaauaguuggaacgaaauuaaagauauuaacaagaaagaccgacuaagcaaacugauaauaaaacacuucccauucuuggaagcuacgacauaucgacagaacccgaccgauacgacaaaacaaaaagaagagaaacaagccgaagcccaaucucuugaaagucugaaaaagucuuuuuuuguuuuuauauauaaacuucgagaccuaagaaaucauuauucccacuacaagcauucuaaaucuuuagaaaggccaaaguuugaggaagauuuacaaaauaagauguauaauaucuuugaugucaguauccaguuuguaaaagaagauuauaaacauaauacagauauaaacccuaaaaaagacuucaaacaucuugauagaaaaagaaaaggaaaguuccauuacucuuuugcagauaacgaaggaaacauaacugaaagcgguuugcucuucuuuguauccuuauuccuugaaaagaaagaugcaauauggguacagaaaaaacuugaaggcuuuaaaugcaguaacaagucauaucagaaaaugaccaaugaaguauuuugcaggagccgaaugcucuugccaaaacuacgauuggaaagcacgcaaacacaagacuggauauugcucgauaugcucaacgagcugauacguugccccaaaucgcuguacgaacgccugcaaggaguaaacagaaaaaaguucuaugucuccuucgacccugcagacgaggacuacgaugcagagcaagagccuuucaaaaacacauugguaaggcaccaagaccguuucccauacuuugcauugcgcuauuucgacuauaacgagguauucgcaaaucuucguuuccaaauagacuugggcaccuaucacuucuccauuuauaagaaacuaaucgguggucaaaaggaagaccgccaccuuacacauaagcuguaugguuuugaacgcauacaagaguuugacaagcagaaucgccccgaugaguggaaagcaaucguaaaagacucagauacuuucaagaaaaaagaagaaaaagaagaagaaaaaccguauaucucggaaacuacaccgcauuaucauuuggagaacaagaagauuggcauugcauuuaagaaucauaauauuuggccgucaacccaaacagaacuaacaaacaauaaaagaaagaaguacaaucuugggacaucaaucaaagcagaggccuuccuaaguguacacgaguuauugccaaugauguucuacuaucuguuguuaaagacggaaaauacuaaaaaugacaauaaaguuggaggaaagaaagaaacaaagaagcaaggaaaacauaagauagaagccauuauugagaguaaaauaaaagacauauaugcccuuuacgaugcuuuugccaauggcgagauaaacagcgaagacgaauuaaaagaauaccuuaagggcaaagauauuaaaauaguacaucugcccaaacaaaugauugccauauugaaaaacgagcauaaagauauggcagaaaaggcugaagccaaacaagagaagaugaaacuugccacagaaaaucgucuaaaaacucuugauaaacagcuaaaaggaaagauacaaaacgguaaaagauacaacagcgcaccaaaaucuggcgagauugccagcugguugguaaacgauaugaugcguuuccagccuguucaaaaagacgaaaauggagaaucgcugaacaacaguaaagccaacagcacagaauaucagcuguugcaacguacgcuugcauucuucggcagcgaacacgaacgccuugccccuuacuucaaacaaacgaagcucauagagaguagcaacccucacccauucuuaaacgauaccgagugggaaaagugcagcaauaucuugucuuucuaucgcagcuauuugaaagcaaggaaaaacuuucuugaaagucuaaagccagaagauugggagaagaaccaauacuuccuuaugcuuaaagagccaaagaccaaccgcgaaacauuggugcaaggguggaagaacggcuuuaaucugccacguggauucuuuacggaacccauaaggaaaugguuuauggagcauuggaaaagcauaaaaguagacgacuuaaaaaggguuggcuugguugcaaaaguaacuccuuuguucuucagugaaaaauauaaagacagcguacagccuuuuuacaacuauccuuuuaacguuggcgauguaaacaaacccaaagaagaggauuucuuacaucgugaggagcguauagaacugugggauaaaaagaaagacaaguucaaggguuauaaagccaaaaagaaguucaaggagaugacggacaaggaaaaagaagagcaccguucuuaucuugaauuucaaucuuggaauaaguuugagcgggaacuacgacuugugcgaaaccaagacaucguaacguggcuguuguguacggaacugauugauaagcugaaaauagacgaacucaauauaaaagaacugaaaaagcuacgcuuaaaggauauuaauacagacacagcaaaaaaagaaaagaacaauauucugaacagaguaaugccgauggaacugccuguuacgguguacaaaguaaacaaaggaggcuauauaauaaagaauaaaccuuugcauaccauuuauauaaaagaggcugaaaccaagcuuuuaaaacaaggaaacuucaaggcuuugguaaaagaccgcaggcucaauggucuguucucguucguuaaaacuccuucugaagcagaaucggagagcaacccuaucagcaaauugcguguagaauaugaacuuggaaaguaucaaaaugcaagacucgauauuaucgaggauauguuggcguuagaaaaaaagcugauagacaaauacaauagcuuggacaccgacaacuuccacaauaugcuuacagguugguuggaacucaaaggcgaggcaaagaaagcaagguuucagaacgacguaaaacuccuuacugccguacggaaugccuuuucgcacaaccaauauccaauguacgaugaaaaucucuucggaaauauugagcgguucagccuuucuucuucuaauauuauagaaaguaaggggcucgauauugcugcaaaacugaaagaggaaguuaguaaggcagcaaaaaaaauacagaacgaggaagauaacaaaaaagaaaaagaaacuuaa

SEQ ID NO: 11104 - RNA, 3378 nt, Artificial Sequence
  Cas13b variant__Prevotella intermedia__KJJ86756.1__Cas13b
augaaaauggaagacgacaagaaaaccacagaaucaacuaacauguuagacaacaagcauuuuugggcggcguuccuuaauuuggcacgccacaaugucuauauuacagugaaccacauuaacaagguacuggagcuaaaaaacaagaaagaccaagauauaauuauugauaaugaccaagacauauuggccauuaaaacucauugggaaaaaguuaauggagaccuuaacaagacagagcgacuaagagaacugaugacaaaacacuucccauucuuggaaacugcaauauacaccaaaaacaaagaagauaaggaagaaguaaaacaagaaaaacaagccgaagcacaaucacuugaaagccuaaaggauuguuuauuucucuuuuuagagaagcuucaagaagcaaggaacuauuauucucacuacaaguauucugaaucuacaaaagagccaauguuagaggaaggauuauuggaaaagauguauaauaucuuugacgacaauauccaguuagugauaaaagauuaccaacauaacaaagauauuaacccugacgaagacuucaagcaucuugacagaaaaggacaauucaaauacucuuuugcagauaacgaaggaaacauaacugaaagcgguuugcucuucuucguuuccuuauuccuugaaaagaaagaugcaauauggaugcagcaaaagcuuacaggcuuuaaagacaauagggaaagcaaaaagaaaaugacccacgagguauuuugcagaagacgaaugcucuugccaaaacuacgauuggaaagcacgcaaacacaagacuggauauugcucgauaugcucaacgagcugauacguugccccaaaucgcuguacgaacgccugcaaggagaauacagaaaaaaguucaauguccccuucgacucugcagacgaagacuacgaugccgagcaagagccuuucaaaaauacauugguaagacaccaagaccguuucccauacuuugcauugcgcuauuucgacuauaacgagauauucacaaaucuucguuuccaaauagacuugggcaccuaucacuucuccauuuauaagaaacuaaucgguggucaaaaggaagaccgccaccuuacacauaagcuguaugguuuugaacgcauacaagaguuugccaaacagaaucgccccgaugaguggaaagcacucguaaaggacuuagauacuuacgaaacuucaaacgaacgauauaucucagaaaccacaccgcauuaucauuuggagaaccaaaagauaggcauuagguuuaggaaugguaacaaggaaauuuggccaucgcucaaaacaaauggcgaaaauaaugaaaaaagcaaguauaaacuugauaaaccauaucaagcagaggcuuucuugagcguacacgagcuacugccaaugauguucuacuaucuguuguuaaagaaggaagaaccuaauaaugacaagaaaaacgcaaguauaguagaaggcuuuauuaaaagagaaaucagagacauguauaaacucuaugaugcuuuugccaauggugagauaaacaacauaggcgauuuagaaaaauacugugaggacaaaggaauccccaaaagacaucugcccaaacagaugguugccauuuuguacgacgagccuaaagauaugguaaaagaggcgaaacgcaagcaaaaggaaaugguaaaggauaccaagaaacugcuugcuacucuugaaaaacaaacacaagaagaaauagaagaugguggaagaaauaucagacugcugaagucuggcgagauugccagauggcugguaaacgauaugaugcguuuccaaccuguucaaaaagacaaugagggcaauccacugaacaacaguaaagccaacagcacagaauaucagaugcugcaacgcucgcuugcgcuuuacaacaaagaagaaaaaccuacucguuacuucagacaaguaaaucucauaaauagcagcaacccccacccuuuucuaaaauggacgaagugggaagaaugcaacaacaucuugucuuucuaucgcaauuaccuaacgaaaaagauagaauuucugaauaaacuaaagccugaagauugggagaagaaccaauacuuccuuaagcuuaaagagccaaagaccaaccgcgaaacauuagugcaaggguggaagaacggcuuuaaucugccacgugguaucuuuacagaaccuaucagagaaugguuuaaaaggcaucagaacgauucuaaggaauacgagaaagucgaagcccucaaaagaguuggcuugguuacaaagguaauacccuuguucuucaaagaagaauauuuuaaagaagaugcccaaaaagaaauuaacaacugcgugcagccauucuacagcuucccuuacaacgugggcaauauacacaaacccgacgaaaaggauuucuuaccuucugaggaacgcaaaaaacuauggggugauaagaaagacaaguucaaggguuauaaagcuaaaguaaaguccaagaaguugacggacaaggaaaaagaagaauaucguucuuaucuugaauuucaaucuuggaauaaguuugagcgggagcuacgacuugugcgaaaccaagacaucguaacguggcuguuguguacggaacugauugauaagaugaaaguggagggacugaacgucgaagaacugcaaaagcuacgcuuaaaggauauugacacagacacagcaaaacaagaaaagaacaauauucugaacagaauaaugccgaugcagcuaccuguuacgguguacgaaauugacgauucccacaauauaguaaaggacagaccuuugcauacuguuuacaucgaagaaacuaaaaccaagcuuuuaaaacaaggaaacuucaaggcuuugguaaaagaccgcaggcucaauggucuguucucguucguugauacuucuucuaaagcagaguugaaagauaaaccuaucagcaaaucgguuguagaauacgaacucggagaguaucaaaacgcaagaauagaaacuaucaaggauauguuguuguuagaaaaaacacugauaaaaaaauaugaaaaguugccaaccgacaacuucagugauaugcuaaaugguugguuagagggcaaagacgagucagacaaagcaagguuucagaacgacguaaaacuccuuguugccguacggaaugccuuuucgcacaaccaauacccaaugcgcaauagaauagcauucgcaaacauuaacccauucagccuuucuucugcugacauuucugaagaaaagaaacuugauauugccaaucagcugaaggauaaaacccacaaaauaauaaaaaaaauaauagaaauagaaaagccaauagaaacuaaagaauaa

SEQ ID NO: 11105 - RNA, 3378 nt, Artificial Sequence
  Cas13b variant__Prevotella pallens__EGQ18444.1__Cas13b
augaaagaagaagaaaaaggaaaaacacccguaguaucaacuuauaacaaggaugauaagcauuuuugggcggcguuccuuaauuuggcacgccacaaugucuauauuacagugaaccauauuaacaagauacugggagaaggugaaaucaaccgugacggauacgaaaauacccuugagaagaguuggaacgaaauuaaagauauuaacaagaaagaccgacuaagcaaacugauaauaaaacauuucccauucuuggaaguuacaacauaucaacgaaacucugccgauaccacaaaacaaaaagaagagaaacaagccgaagcccaaucucuugaaagucugaaaaagucuuuuuuuguuuuuauauauaaacuucgagaccuaagaaaucauuauucccacuacaagcauucuaaaucuuuagaaaggccaaaguuugaggaagauuuacaagagaagauguauaauaucuuugaugcaaguauccaguuaguaaaagaagauuauaaacauaauacagauauaaaaacugaagaagacuucaagcaucuugacagaaaaggacaauucaaauacucuuuugcagauaacgaaggaaacauaacugaaagcgguuugcucuucuucguuuccuuauuccuugaaaagaaagaugcaauauggguacagaaaaaacuugaaggcuuuaaaugcaguaacgagucauaucagaaaaugaccaaugaaguauuuugcaggagccgaaugcucuugccaaaacuacgauugcaaagcacacaaacacaagacuggauauugcucgauaugcucaacgagcugauacguugccccaaaucgcuguacgaacgccugcgagaagaggacagaaaaaaguucagaguccccaucgaaaucgcagacgaagacuacgaugcagagcaagagccuuucaaaaacgccuugguaaggcaccaagaccguuucccuuacuuugcauugcgcuauuucgacuauaacgagauauucacaaaucuucguuuccaaauagacuugggcaccuaucacuucuccauuuauaagaaacaaaucggugauuauaaagaaagccaucaucuuacgcauaagcuguaugguuuugaacgcauacaagaauuuaccaagcagaaucgccccgaugaauggagaaaauuuguaaagacuuucaacucuuucgaaacuucaaaagagccguauaucccagaaaccacaccgcauuaucauuuggagaaccaaaagauaggcauuagauuuaggaaugauaacgauaaaauuuggccaucgcucaaaacaaauagcgaaaagaaugaaaaaaguaaguauaaacuugauaaaucauuccaagcagaggcuuuccuaaguguacacgagcuauugccaaugauguucuacuaucuguuguuaaagacggaaaacacugauaaugacaaugaaauagaaacaaagaagaaagaaaauaaaaacgauaaacaggaaaaacauaagauagaagaaaucauugagaauaaaauaacagaaauauaugcccuuuacgaugcuuuugccaaugguaagauaaacagcauagacaaguuagaagaauacuguaaaggcaaagauauugaaauaggacaucugcccaaacagaugauugccauauugaaaagcgagcauaaagauauggcaacagaggcgaaacgcaagcaagaagaaauguuagcugauguccaaaagagccuugaaucucuugauaaucaaauaaaugaagagauagaaaacguugaaagaaagaauagcucauugaaaucuggcgagauugccagcugguugguaaacgauaugaugcguuuccagccuguacaaaaagacaaugagggcaauccacugaacaacaguaaagccaacagcacagaauaucagaugcugcaacgcucgcuugcgcuuuacaacaaggaagaaaaaccuacucguuacuucagacaaguaaaccucauagagaguagcaacccucacccauucuugaacaauaccgagugggaaaagugcaacaauaucuugucuuucuaucgcagcuauuuggaagcaaagaaaaacuuucuugaaagucuaaagccagaagauugggagaagaaccaauacuuccuuaugcuuaaagaaccaaagaccaacugcgaaacauuggugcaaggguggaagaacggcuuuaaucugccacguggaaucuuuacagaacccauaaggaaaugguuuauggagcaucggaaaaacauaacaguagccgaguuaaaaagaguuggcuugguugcaaaaguaauuccuuuguucuucagugaagaauauaaggacagcguacagccuuuuuacaacuaucuuuuuaacguugguaacauaaacaaacccgaugaaaagaauuucuuaaauugugaggaacguagagaacuauugcguaaaaagaaagacgaguucaagaagaugacggacaaggaaaaagaagaaaacccuucuuaucuugaauuucagucuuggaauaaguuugaacgggagcuacgacuugugcgaaaccaagacaucguaacguggcuguuguguauggagcuguuuaauaaaaagaagauaaaggaacuaaacgucgaaaaaauauauuuaaagaauauuaauacaaauacaacaaaaaaagaaaaaaauacagaagaaaagaacggagaagaaaagauuauaaaggaaaagaauaauauucugaauaggauaaugccaaugcgauuaccuauuaaaguauaugggagagaaaacuucucuaagaacaaaaagaagaagauaagaaggaauacuuuuuuuaccguuuacauugaagaaaaaggaacuaaacucuuaaaacaaggcaacuucaaagcuuuggaaagagaccgcagauuggguggucuauucucguucguuaaaacucauucuaaagcagaaucgaagaguaauacuaucagcaaaucacguguagaauaugaacuuggagaguaucaaaaagcaagaaucgaaauuaucaaagauauguuggcguuagaagaaacgcugauagacaaauacaauagcuuggacaccgacaacuuccacaauaugcuuacugguugguugaaacucaaagacgagccagacaaagcaaguuuccagaacgacguagaccuccuuauugccguacggaaugccuuuucgcacaaccaauacccaaugcgcaauagaauagcauucgcaaauauuaauccauucagccuuucuucugcuaauacuucugaagaaaagggacuugguauugccaaucagcugaaggauaaaacccacaaaacgauagaaaaaauaauagaaauagaaaagccaauagaaacuaaagaauaa

SEQ ID NO: 11106 - RNA, 3453 nt, Artificial Sequence
  Cas13b variant__Prevotella saccharolytica__EKY00089.1__Cas13b
augauggaaaaagaaaauguacaagguagccauaucuauuaugaaccuacugacaaaugcuucugggcggcuuucuauaaucuggcucgccacaacgcguaucuuaccauagcgcacaucaauaguuuugucaauucuaaaaaaggaauuaacaacgaugauaagguuuuagacaucauugaugauuggaguaaguuugauaacgacuugcuuaugggugcccguuuaaacaaacuuauucucaaacauuuucccuuuuuaaaggccccuuuauaccaguuggcaaagcggaaaacccgcaaacagcaaggaaaagagcagcaagauuaugaaaaaaagggggaugaagacccggaaguuauucaagaagcaauagcaaaugccuuuaaaauggcgaauguucgaaagacuuuacaugcuuuuuuaaagcaacuugaagauuuaagaaaccauuuuucgcauuauaacuauaauucuccugccaaaaaaauggagguaaaauucgaugauggcuuuuguaacaagcuuuacuacguguuugaugcugcguugcaaauggugaaggaugacaacagaaugaauccggaaauuaauaugcaaacagauuuugaacaucuugugcgauuagguagaaaccgcaagauuccuaauacguuuaaauacaacuuuacaaauucugacggaacgauuaacaacaacggacugcucuuuuuuguaucgcuuuuucucgaaaagcgcgaugccaucuggaugcaaaaaaagauaaagggauuuaaaggcggcaccgagaacuauaugcggaugaccaaugagguguuuugcagaaauagaauggucauuccuaaacugcgauuagaaaccgauuacgacaaucaucaacugauguucgauaugcucaacgaacucguucgaugcccccuuucguuauacaaacgcuuaaaacaggaagaccaagauaaauuccggguacccauagaguuccuugaugaggauaaugaagcugacaauccauaucaagaaaacgccaacagugaugaaaacccaacugaagaaaccgacccauuaaagaauacacucguucgucaucagcaccguuuucccuauuucguguugcguuauuucgauuuaaacgagguuuuuaaacagcuccgcuuucaaauaaacuuagguuguuaucauuuuucgauauacgauaaaaccauuggcgaacgcacugaaaagcgccaucuuacgcgcacccucuuuggguuugaucgguuacagaacuucucugucaaguugcaaccugagcauuggaaaaauauggugaaacauuuggauaccgaagagaguucagauaagccuuaucuaucugaugcgaugccucauuaucagauugaaaaugaaaagauaggcauucauuucuuaaagaccgauacagagaaaaaagaaacgguauggccgucguuagaggucgaagaagucagcaguaacagaaauaaauacaagucugagaagaaccucacggcagaugcuuuccucaguacacacgaguuauugcccaugauguuuuauuaucagcuguugaguagcgaagaaaaaacucgggcugcggcaggcgauaaggugcaagguguauugcaaaguuaccgcaaaaagauuuuugauauauacgaugauuuugccaauggcaccaucaauucuaugcaaaaacuugaugaacgguuagcaaaagauaacuuguuaaggggaaauaugccccaacaaaugcuugcaaucuuagaacaucaagagccggauauggagcagaaagcgaaagagaaacucgaucggcucauaacugaaacgaaaaaaagaauaggcaaauuggaggaucaauucaaacaaaaaguaaggauaggcaaacgccgcgcagacuuaccgaagguaggaagcauugccgauuggcugguuaacgacaugaugcgcuuucaaccugcaaaacguaaugccgauaauacgggugugccggauaguaaagccaauagcaccgaauaucguuuguugcaagaggcauuggcauuuuauagcgccuauaaagaucguuuggaaccuuauuuccgacaagucaaccucauagguggcaccaauccucauccguuuuuacacaggguugauuggaaaaaauguaaucaucuauuaucauuuuaucacgauuaucucgaagcuaaagagcaauaucuaucccaucuaucgccugcugauuggcaaaagcaucaacauuucuugcuuuuaaaagugagaaaagacauccagaaugaaaagaaagacuggaaaaagagcuugguugcaggcuggaaaaauggcuuuaaucuaccacgcggacucuuuaccgagucuauuaaaacaugguucucaacagaugcagauaagguucagauuaccgacacaaagcuuuuugaaaaccgaguggggcuuauugccaaacuuaucccucuauauuacgauaagguguacaaugacaagccccaaccuuuuuaucaauaccccuuuaauaucaacgacagauauaaacccgaagauacccgcaaacgauuuacggcagcaucuucuaagcuguggaacgaaaagaaaaugcuuuauaaaaaugcacaaccggacucaucugacaaaauagaguauccgcaauaucuugauuuccugucguggaaaaagcucgaacgcgaacugcguaugcugcgcaaucaagauaugauggugugguugaugugcaaagaucucuuugcacaguguacgguagaagggguagaauuugcugauuugaaguuaagucaauuggaaguagauguuaauguacaggacaaucuaaauguuuugaacaaugucaguaguaugauauugccccugucgguuuauccuucggaugcgcaagguaauguucucagaaacaguaaaccucuacacacuguuuauguacaagaaaauaacacuaaacuuuuaaagcagggcaacuuuaaaucgcuauuaaaagaccggcguuuaaauggcuuauucucuuucaucgcagcugaaggagaagaccugcaacagcauccguugacaaaaaacaggcucgaauacgaauuaaguaucuaucaaacaaugcggaucucuguguuugagcaaacgcuucaacucgaaaaagccauccuuacucgaaacaaaacgcugugugguaacaacuuuaacaauuugcucaacagcuggagcgaacaccgcacagauaagaaaaccuuacagcccgacaucgauuuucugauugcugugcgcaaugcuuucucacacaaccaauaucccaugucuaccaauacgguuaugcaagguaucgaaaaguuuaauauccaaacccccaaacuugaagaaaaagauggacuuggaauagcuucucagcuggcaaagaaaaccaaagaugcugccagccgucuucaaaauaucauaaauggaggaaccaacuaa

SEQ ID NO: 11107 - RNA, 3969 nt, Artificial Sequence
  Cas13b variant__Prevotella sp.__WP_036929175.1__Cas13b
augaguaaagaaugcaaaaaacagcggcaggagaagaaacguagacuacagaaagccaacuucaguaucagucuaacgggcaagcauguuuuuggcgccuauuuuaauauggcgcguaccaauuuuguuaagaccaucaacuauauuuugccgauugcaggaguacguggaaacuauuccgaaaaccaaauaaacaaaaugcuucaugcucuguuuuugauacaggcaggacgcaaugaagaauugacuacugagcagaaacaaugggagaagaaacugcgucuuaauccagagcagcaaacuaaauuccaaaagcuccucuucaaacauuucccuguacucggcccaaugauggcagauguggcugaccauaaagccuaucucaauaagaagaaaucaacggugcagacagaggaugagacuuuugccaugcuuaaaggugugucauuggcugacugcuuggauaucaucugucucauggcugauacucucacagaaugccgcaauuucuauacccacaaagacccuuacaacaagccgucgcaauuagcugaucaauaucugcaucaggagaugauugccaaaaaguuggauaagguagugguugcaagccggcguauuuugaaagaccgcgaaggguugucuguuaaugaaguagaauuccuaacuggaaucgaccauuugcaucaagagguguuaaaagaugaauuugguaaugcgaagguaaaagauggcaaggugaugaagacuuuuguugaauacgaugauuucuauuuuaagaucucugguaaacgucuugucaauggcuauaccgucacaacuaaggacgauaagccuguuaauguaaacacuauguugccagcccuuuccgacuuuggacuacuauauuucugcguccuguuccuuucaaaaccauacgcuaaauuguuuauugacgagguucgucuuuuugaauacagcccguuugaugacaaagaaaacaugauuaugagcgagaugcucaguaucuaccguauucguacuccacgccugcauaagauugauagucaugauagcaaggcaacacuggcuauggauaucuucggagaacugcgucguugccccauggaacucuauaacuugcucgacaagaaugcuggacagccauucuuccacgaugaagugaaacaucccaauagucauacaccugauguuucaaaacgauugcgauaugacgaccguuucccaacguuggcccuucguuauaucgacgaaacugaguuauucaagcgcauucgcuuucagcuccaguuagguucuuuucguuacaaguucuacgauaaggagaauuguaucgacggaagaguacgugugcgucguauccagaaagaaauuaauggauauggacgaaugcaagaaguggcugacaagcguauggauaaauggggagaccugauucaaaaacgagaagaacguucagugaagcuggaacacgaagaacuauauauuaacuuggaccaguuucuugaggauacagccgauucaacuccuuacguuacagaucggcgacccgccuacaauauucaugcuaaucguauuggauuguauugggaagauagccagaauccuaaacaauauaaaguguuugaugaaaacggaauguauauuccagaacuaguugugacugaagauaaaaaggcucccauuaagaugccugcaccucguugugcacuuagcgucuacgaccugccugcuaugcuuuucuaugaauaccuucgcgaacaacaagauaaugaguucccuucugccgagcaaguuauuauugaauaugaggacgacuaccgcaaguucuucaaggcuguagcagaaggaaaacugaagccauuuaagaggcccaaagaguuccgugauuuuuugaagaaagaauauccgaaacuccggauggcugauauacccaagaaauugcaacuuuuuuuguguagucaugguuuauguuauaacaauaagccugaaacgguguaugaacguuuagauagacuuacuuugcagcaucuugaagaacgcgaacuucauauucagaaucguuuggagcacuaucagaaagaucgugauaugauaggcaauaaggauaaucaauauggaaaaaagagcuuuuccgauguucgccauggugcucuugcacguuaucuggcucaaaguaugauggaguggcaaccuaccaaacuuaaggauaaagaaaagggucaugauaaguuaacgggauuaaacuauaauguucuuacagccuaucuugccaccuauggccacccccaaguuccagaagaggguuuuacaccucgcacuuuggagcagguuuuaauaaaugcacaucucauaggaggcaguaauccucauccuuuuauaaauaagguuuuggcucuuggcaacaggaauauugaggaacuauaucugcacuauuuggaagaagaacucaaacauauccgcucucguauacagucauugucgaguaauccuucugacaaggcauuaucugcauuaccuuuuauucaucacgaccgcaugagauaccaugaacguaccagcgaagagaugauggcuuuggcagcacgcuauaccacuauacaacugccagaugguuuguuuacuccauauauccuggaaauacugcaaaagcauuauacugagaacucugaucugcaaaaugcucucagccaagauguuccagucaagcuuaauccaacgugcaaugcugcuuaucucauaacauuauucuaucagacaguauuaaaggauaaugcccagccuuucuacuugucagauaagaccuacacucggaauaaagauggugaaaaagcagagucauucucguuuaaacgcgccuaugaauuguuuuccguauuaaauaauaacaagaaggauacuuucccauuugaaaugauuccgcuguuccuaacaagcgaugagauucaggaacgccugucugcaaaacuccuugacggcgauggaaauccugucccagaaguaggagaaaaagguaaaccugcaacagauagucaggguaauacuaucuggaagcgacgcaucuauucugaaguggaugauuacgcugaaaaauugacugacagggauaugaaaauuaguuucaaaggcgaaugggaaaaacugccacgcuggaaacaagauaaaauuauuaagcgaagggaugaaacucgccggcagaugcgcgacgaacuguugcaacggaugccacguuauauacgugauaucaaggacaacgaacguacacuucgucgcuauaagacgcaggauaugguauuguuucuccuggcugagaagauguuuacaaauaucaucagcgaacagagcagugaauuuaauuggaaacagaugcggcuuuccaagguauguaacgaggcuuuccugcgucagacgcuuacuuuccguguuccaguaacaguuggugaaacaaccauauauguagaacaagagaauaugucgcucaagaacuauggugaguucuaucguuuccuuacagaugaucgucugaugagucuguugaauaacauuguggaaacgcuaaaaccuaaugagaauggcgaccuuguuauccgucauaccgauuugaugagcgagcuggcugcauacgaucaguaucguucuaccaucuucauguugauucagaguaucgagaacuugauuauuacgaacaacgcuguacuugaugacccugaugcagauggcuucuggguucgugaagaucuuccuaaacgcaauaacuuugcaucauuauuggaacugauaaaucaguugaauaauguggaguugacugacgaugaacguaaguuacucgucgccauccguaaugccuucagucauaauaguuauaacauugacuucucucugauuaaggauguuaagcaucugccagaagucgccaaaggcauucugcaacaucugcaaucgaugcuuggcguagaaauaacgaaguag

SEQ ID NO: 11108 - RNA, 3384 nt, Artificial Sequence
  Cas13b variant__Prevotella sp.__WP_007412163.1__Cas13b
augcaaaaacaagauaaauuauuuguagauagaaagaaaaaugcuauauuugccuuuccuaaauauauaacaauaauggaaaaccaagagaaaccugaaccaauuuauuaugaauugacagauaagcauuucugggcugccuuucuuaacuuggcgcgccacaaugucuauaccaccauuaaucacaucaacagacguuuggaaauagcagagcuaaaagacgauggauauaugaugggcauuaaaggcaguuggaacgaacaagcgaaaaaacucgacaaaaaaguucggcugagagacuugaucaugaaacacuuuccuuuucuggaagcugcagcuuaugaaauaacaaacucuaaaagucccaacaauaaggagcaacgggaaaaggaacaauccgaagcccuaucacuuaacaacuugaagaauguucuauucauuuucuuggaaaaacuucagguucucaggaacuacuacucccauuacaaguauucugaagaauccccaaaaccaauauuugaaacaagccuuuugaaaaacauguauaagguuuucgaugccaaugugcgguuaguaaagagagacuauaugcaucaugagaauauagacaugcaaagagauuuuacacaucucaacaggaaaaaacaagugggacgaacaaaaaacaucauagacaguccuaacuuucauuaccauuuugcagauaaagaaggcaauaugaccauagcaggcuuacuguucuucgucucuuuauuucuugauaaaaaagacgcuauuuggaugcagaaaaagcuaaagggauuuaaagauggcagaaacuugcgugagcaaaugacaaacgaaguauuuugcagaagccguauaucuuugccuaagcuaaaauuagagaauguacagacaaaagacuggaugcaacuugauaugcuuaacgaauugguucgcugucccaaaucgcuguaugaacgguuacgagaaaaagauagggaaaguuuuaaaguaccuuucgauauuuucucugacgacuaugaugcugaagaagaaccauuuaagaacacgcuuguaaggcaucaagaccgcuuuccauauuuugucuugagauauuucgauuuaaaugagauauucgaacaacuccgcuuccaaauagauuuagguaccuaucauuucucuaucuauaacaaacguauuggugacgaagaugaaguucgccaucucacacaucaucuauauggcuuugcgcgcauucaggacuuugcaccacaaaaccaaccagaagaauggagaaaauuagugaaagacuuagaucauuuugagacaucgcaagagccuuacauaucuaagacugcuccacauuaccauuuagagaaugaaaagauaggcauuaaguuuugcaguacccacaacaaccucuuuccaucucucaaaagagaaaagacaugcaauggaagaaguaaauuuaaucucggaacacaauuuacggcagaagcauuuuuaaguguccacgaauuguugccgaugauguuuuauuaucuguuauugaccaaggauuacuccagaaaagaaagcgcagacaaaguagagggaauuauaagaaaagaaauaagcaacauauacgcuaucuacgaugcuuuugccaauaaugagauaaauagcauugcagaccuaaccugccgacuucaaaaaacaaauauacuacaaggccauuugccaaagcaaaugauuuccauauuggaaggcagacaaaaagauauggaaaaagaggcugagcgcaagauuggggaaaugauagacgacacccaaagaagacuugacuugcucugcaagcagacaaaucagaagauaaggauuggcaaaaggaaugccggucugcuaaaaucgggaaaaauugcagauugguugguaagcgauaugaugcguuuccaaccuguccaaaaagacaccaauaaugcucccauaaacaacagcaaagccaauagcaccgaauaucggaugcuucagcaugcgcuugcgcuuuuuggcagugagagcucccgucuuaaagcuuauuucaggcaaaugaaccuugugggaaaugccaauccgcauccuuuccuugcagaaacacaaugggaacaucaaacuaacauucugucuuucuaccgaaacuauuuggaagcgaggaaaaaguaucuuaaaggcuuaaaaccacaaaacuggaaacaauaucagcauuuucucauacuuaaaguacagaagaccaaccgcaacacauuaguuacaggauggaaaaacaguuucaaucucccccguggaauauuuacccaaccaauaagggaaugguuugagaaacauaauaauucaaaaagaauauacgaccaaauacuaucuuuugaccgaguaggauuuguugcaaaagcuauucccuuauacuuugcagaagaauauaaagacaauguacagccuuucuacgauuauccguucaauaucggcaacaaacuuaaaccacaaaaagggcaauucuuagauaaaaaagagcgugucgaauuguggcaaaagaauaaagagcuauucaaaaauuauccgucugaaaagaauaagacagacuuagcuuaucuugauuuccuaucauggaaaaaguuugaacgcgaacugcgacuuaucaagaaucaggauaucgucacaugguugauguucaaggaacuauucaaaacgacaacuguggaaggauugaagauuggggaaauacaucuaagggacaucgauacaaacacggcaaaugaggaaagcaacaauauucuaaauagaaucaugcccaugaaguugccuguuaaaacauacgaaacagacaauaaaggaaauauauuaaaggaaagaccuuuagcaaccuuuuauaucgaagaaacggaaaccaaaguccugaaacagggcaauuucaaaguauuggcaaaagaccgcaggcucaacggacuacuuucuuuugcagaaacuacagacauugauuuagaaaaaaauccuaucaccaaauugaguguagacuaugagcuuauaaaauaucagacuacaaggauuaguaucuuugagaugacauuaggacuggaaaagaaacucauagacaaauauuccacacuaccuacagauagcuucagaaauaugcuugaaaggugguugcagugcaaagcuaauagaccggaauuaaagaauuacguuaauaguuugauugcagugagaaaugcuuuuucccacaaccaguaucccauguaugaugccacacucuuugcugaaguuaaaaaauuuacccuuuucccuucugucgauacaaaaaagauugagcuaaauauagcgccacaguuacuggaaauaguaggaaaagccauaaaagaaauugaaaaaucagaaaauaaaaacuaa

SEQ ID NO: 11109 - RNA, 3273 nt, Artificial Sequence
  Cas13b variant__Prevotella sp.__WP_044072147.1__Cas13b
augaauauaccugcauuaguggaaaaccagaagaaguauuucggaacauacucugucauggcaaugcugaacgcacagaccguacucgaccacauacagaaaguggccgacauagagggggaacagaacgagaacaacgaaaaucuaugguuccaccccguaaugagccauuuauacaaugcgaagaauggauaugacaaacagccggaaaagacuauguucaucaucgaacgucugcagucauauuuuccuuuccucaagauuauggcugaaaaccaaagagaguauucgaacggaaaauacaaacagaauaggguugaggugaacagcaacgacaucuuugaaguucugaaaagggcuuucggugugcugaaaauguaucgugaccaggccagccauuacaagacauacgaugagaagcugauugacgguugcgaguuucugacaaguacugagcagccucuuuccggaaugauaaacaacuacuacacuguagcacugcgaaacaugaaugagcguuauggauacaaaaccgaagaccucgccuuuauacaggacaaaagauucaaauucgucaaagacgcauacggaaaaaagaaaucacaaguaaauaccgguuucuuccucaguuugcaagacuacaacggcgacacacaaaagaaacuccacuugucuggagucggcauagccuugcuuaucugucuguuccucgacaagcaguauaucaacaucuuccugucaaggcuuccuaucuucucuuccuauaaugcacaaucggaagagcgacgcaucaucauccguucuuuuggaauaaacagcaucaagcagcccaaagaccgcauccacucggaaaagagcaacaagucgguggccauggauaugcucaaugaaauaaagcguuguccaaacgaacuguucgaaacacucucggcagaaaagcagucucgauucagaaucauuuccaaugaccacaacgaagugcuuaugaagcguaguuccgacagauucgugccauugcuauugcaauauauugacuacggcaagcuguucgaccacauccguuuucaugugaauauggggaaacugcgcuaucugcucaaagccgacaagaccugcaucgacggucagacacgagugagggugauagaacagccucucaacgguuucggaagauuggaagagguugaaacgaugagaaagcaagaaaacggaacuuucggcaauagcggcauucguauucgcgauuuugagaacaugaaaagagacgaugccaauccugcaaacuauccauacaucguggacacauacacucacuauauacuggagaacaacaagguggaaauguucauaagcgaugaagaaaccccugccccauuguugccuguaauugaggaugacagauaugugguaaagaccauuccauccugccguaugagcacucuugaaauaccugccauggcauuucauauguuccuguucgguagcaaaaagaccgaaaagcuuauugucgauguucacaacagguauaagagauuguucaaagcgaugcaaaaagaagaggugacagcugaaaacauagccucuuucggcauugcagaaagugaucugccccagaagauuauugaccucaucagcgggaaugcucauggcaaggacguugacgccuucaucaggcuuaccguugaugacaugcuugccgauaccgaacggcgcaucaagagauuuaaagacgaccguaaauccauacguucugccgacaacaagaugggcaagcgcgguuucaaacagauuucuacagguaagcuggcggauuuccucgccaaagacauuguguuguuccaaccuucuguaaaugauggcgagaacaagauuacgggauugaacuaccgcaucaugcagucugccaucgccguuuacaacaguggcgacgauuaugaagccaagcaacaguucaagcugauguuugagaaagcccggcucaucggcaaaggcacaacagagccucauccuuuccuauauaagguauuugugcgcucuaucccugccaaugccguggauuucuacgagagguaucuaauagagcgcaaauucuaucucaucggacucuccaacgagauaaagaagggaaacaggguggaugugccuuucaucagacgagaccagaacaaauggaaaacaccugcuaugaagacucucggcagaaucuaugaugaagaccugccgguggaauugccucgacagauguucgacaacgaaaucaagagccaccugaaaucgcugccgcagauggagggcauugauuucaauaaugccaacgucacguaucucaucgcagaauauaugaaacguguauugaaugaugacuuccagacauucuaucaguggaagcgcaacuaucgcuauauggacaugcugaggggugaauacgacagaaaaggcucguugcagagcuguuucacauccguagaagaaagagaagguuuauggaaagaacgugcaagccggacugaacgcuacagaaaacuggcuucaaacaaaaucaggucuaacagacagaugcguaaugccucuucugaagaaauugaaacgauauuagacaagcguuugaguaacagccgcaacgaauaccagaaaagugagaagguaauccgcagauacagaguacaggaugcccugcucuucuuauuggcaaagaagacucugacggaacuggcggauuucgacggcgagagauucaaacugaaagagauuaugccugacgcagaaaagggaauccugucugagauuaugccuaugucauucacuuuugaaaagggcggcaagaaauauaccauaacaucggaaggcaugaagcugaagaacuauggugauuucuucgucuuggcaagcgacaagagaaucggcaaccuguuagaacuuguuggcuccgacacuguauccaaggaggacaucauggaagaauucaagaaguaugaccaaugccgaccggaaauaucgagcaucguuuucaacuuggagaaaugggcauucgacacuuauccugaguugucagcgagaguugacagagaagaaaagguugauuucaaguccaucuuaaagauucuccuaaacaacaagaauaucaauaaagaacaaagugacauauugcgaaaaaucaggaaugcuuucgaccacaacaacuaucccgacaaagguguuguugagauaagggcuuugccugaaauugccaugagcauaaagaaagcauuuggagaauaugccaucaugaaauag

SEQ ID NO: 11110 - RNA, 3273 nt, Artificial Sequence
  Cas13b variant__Prevotella sp.__WP_042518169.1__Cas13b
augaauauaccugcauuaguggaaaaccagaagaaguauuucggaacauacucugucauggcaaugcugaacgcacagaccguacucgaccacauacagaaaguggccgacauagaaggugaacagaacgagaacaacgaaaaucuaugguuccaccccguaaugagccauuuauacaaugcgaagaauggauaugacaaacagccggaaaagacuauguucaucaucgaacgccugcagucauauuuuccuuuccucaagauuauggcugaaaaccaaagagaguauucgaacggaaaauacaaacagaauaggguugaggugaacagcaacgacaucuuugaaguucugaaaagggcuuucggcgugcugaaaauguaucgcgaccuaaccaaccauuacaaaaccuacgaagaaaagcugaucgacggcugcgaguuucugacaaguacugagcagccucuuuccggaaugauaagcaaauacuacacuguagcccugcgaaacacaaaggagcguuauggauacaagaccgaagaccuggcauucauacaggacaacauaaaaaaaaucaccaaagacgcauacgggaaaaggaaaucacaaguaaauacugguuucuuccucagucugcaagacuacaacggcgacacacaaaagaaacuccacuugucuggagucggcauagccuugcuuaucugucuguuccucgacaagcaguauaucaacaucuuccugucaaggcuuccuaucuucucuuccuauaaugcacaaucggaagagcgacgcaucaucauccguucuuuuggcauaaacagcaucaaacugcccaaagaccgcauccacucugaaaagagcaacaagucgguggcuauggauaugcugaaugaggugaagcguuguccggacgaacuguucacuacacucucggcugaaaagcagucucgauucagaauuauuuccgacgaccacaacgaggugcuuaugaagcguagcaccgacagauucgugccauugcuauugcaauauaucgacuacggcaaguuguucgaccacauccguuuucaugucaacauggggaaacugcgcuaucugcucaaagccgacaagaccugcaucgacggucagacucgagugagggugauagaacaaccucugaacgguuucggaagauuggaagaggcugaaacgaugcgaaagcaagaaaacgggacuuucggcaacagcggcauccgcauucgcgauuuugagaaugugaaaagagacgacgccaauccggcaaacuauccauauaucguggacacuuacacucacuauauacuggaaaacaacaagguggaaauguucauaagcgauaaagggagcucugccccauuguugccucugauugaggaugacagauaugugguaaagaccauuccauccugccguaugagcacucuugaaauaccugccauggcauuucauauguuccuguucgguagcaaaaagaccgaaaagcuuauugucgauguucacaacagguauaagagauuguuccaagcgaugcaaaaagaagagguaacagcugaaaacauagccucuuucggcauugcugaaagcgaucugccccagaagauucuugaucucaucagcggaaaugcucauggcaaggauguugacgccuucaucaggcuuaccgucgacgacaugcuuaccgauaccgaacggcgcaucaagagauuuaaagacgaccgcaaauccauacguucugccgacaacaagaugggcaagcgcgguuucaaacagauuucuacagguaagcuggcggauuuccucgccaaagacaucguuuuguuccagccuucuguaaaugacggcgaaaacaagauuacgggauugaacuaucgcaucaugcagucugccaucgccguuuacgacaguggcgacgauuaugaagccaagcaacaguucaagcugauguuugagaaagcccggcucaucggcaaaggcacaacagagccucauccuuucuuauauaaggucuuugcgagaucuaucccugccaacgccguggauuucuacgagagguaucuaauagagcgcaaguucuaucucaccggacucugcaacgagauaaagaggggaaacaggguggaugugccuuucaucagacgugaccagaacaaauggaaaacaccugcuaugaagacucucggcagaaucuacucugaagaccugccgguggaguugccucgacagauguuugacaacgaaaucaagagccaccugaaaucgcugccgcagauggagggcauugauuucaauaaugccaacgucacguaucucaucgcagaauauaugaaacguguauugaaugaugacuuccagacauucuaucaguggaagcgcaacuaucacuauauggacaugcugaagggggaauacgacaggaaagguucgcugcagcacugcuucacauccguagaagaaagagaagguuuauggaaagaacgugcaagccggacugaacgcuacaggaaacuggcuucaaacaaaaucaggucuaacagacagaugcguaaugccucuucugaagaaaucgaaacgauauuagacaagcguuugaguaacugccgcaacgaauaccagaaaagugagaaggugauccgcagauacagaguacaggaugcgcugcucuucuuauuggcaaagaagacucugacggaacuggcggauuucgacggcgagagauucaagcugaaagagauuaugccugaugcagaaaagggaauccugucugagauuaugccuaugucauucacuuuugaaaagggcggcaagaaauauaccauaacaucggaaggcaugaagcugaagaacuauggugauuucuucgucuuggcaagcgacaagagaaucggcaacuuguuagaacuuguuggcuccgacauuguauccaaggaggacaucauggaagaauucaauaaguaugaccaaugccgaccugaaauaucgagcaucguauucaacuuagagaaaugggcauucgacacuuauccugaguugucagcgagaguugacagagaagaaaagguugauuucaaguccaucuuaaagauucuccuaaacaacaagaauaucaauaaagaacaaagugacauauugcgaaaaaucaggaaugcuuucgaccacaacaacuaucccgacaaagguauuguugagauaaaggcuuugccugaaauugcuaugagcauuaaaaaagcauucggagaauaugccaucaugaaauag

SEQ ID NO: 11111 - RNA, 3273 nt, Artificial Sequence
  Cas13b variant__Prevotella sp.__WP_044074780.1__Cas13b
augaauauaccugcauuaguggaaaaccagaagaaguauuucggaacauacucugucauggcaaugcuuaacgcacagaccguacucgaccacauacagaaaguggccgacauagaaggugaacagaacgagaacaacgaaaaucuaugguuccaccccguaaugagccauuuauacaaugcgaagaauggauaugacaaacagccggaaaagacuauguucaucaucgaacgccugcagucauauuuuccuuuccucaagauuauggcugaaaaccaaagagaguauucgaacggaaaauacaaacagaauaggguugaggugaacagcaacgacaucuuugaaguucugaaaagggcuuucggcgugcugaaaauguaucgcgaccuaaccaaccauuacaaaaccuacgaagaaaagcugaucgacggcugcgaguuucugacaaguacugagcagccguuuuccggaaugauaagcaaauacuacacuguagcccugcgaaacacaaaggagcguuauggauacaaggccgaagaccuggcauucauacaggacaacagauacaaauucacaaaagacgcauacgggaaaaggaaaucacaaguaaacacugguuccuuccucagucugcaagacuacaacggcgauacgacaaagaagcuccaucucucaggagucggcauagcccugcucauuugccuguuccucgacaagcaguauaucaaccucuuccugucaaggcuuccuauauucucuucauacaaugcacaaucagaagagcgacgcaucaucauccguucuuuuggaauaaacagcaucaagcagcccaaagaccgcauccacucggaaaagagcaacaagucgguggcuauggauaugcugaaugaggugaagcguuguccggacgaacuguucacuacccucucggcugaaaagcagucucgauucagaauuauuuccgacgaccacaacgaggugcuuaugaagcgcaguuccgacagguucgugccauuguuguugcaauauauugacuacggcaaguuguucgaccacauccguuuucaugugaauauggggaagcugcgcuaucuucugaaagccgacaagaccugcaucgacggucagacacgagugagggugauagaacagccucucaacgguuucggaagauuggaagagguugaaacgaugagaaagcaagaaaacggaacuuucggcaauagcggcauucgcauucgcgauuuugagaacaugaaaagagacgaugccaauccugcaaacuauccauacaucguggaaacauacacucacuauauacuggagaacaacaagguggaaauguucauuagcgaugaagaaaacccuaccccauuguugccuguaauugaggaugacagguaugugguaaagaccauuccauccugccgcaugagcacucuugaaauaccagccauggcguuucauauguuccuguucgggagcgagaagaccgaaaagcugauaaucgauguucaugacagguacaagagauuguuccaagcgaugcaaaaagaagaggugacagcugaaaacauagccucuuucggcauugcugaaagcgaucugccccagaagauuauggaucuuaucagcggaaaugcucauggcaaggacguugacgcauucaucagacuuaccgucgacgacaugcuuaccgauaccgaacggcgcaucaagagauuuaaagacgaccguaaauccauacguucugccgacaacaagaugggcaagcgcgguuucaaacagauuucuacagguaagcuggcggauuuccucgccaaagacauuguguuguuccaaccuucuguaaaugauggcgagaacaagauuacgggauugaacuaccgcaucaugcagucugccaucgccguuuacgacaguggcgacgauuaugaagccaagcaacaguucaagcugauguuugagaaagcccggcucaucggcaaaggcacaacagagccucauccuuuccuauauaagguauuugugcgcucuaucccugccaaugccguggauuucuacgagagguaucuaauagagcgcaaauucuaucucaucggacucuccaacgagauaaagaagggaaacaggguggaugugccuuucaucagacgagaccagaacaaauggaaaacaccagcgaugaagacucucggcagaaucuacucugaagaccugccgguggaauugccucgacagauguuugacaacgaaaucaagagccaccugaaaucgcugccgcagauggagggcauugauuucaauaaugccaacgucacguaucucaucgcagaauauaugaaacguguauugaaugaugacuuccagacauucuaucaguggaagcgcaacuaucgcuauauggacaugcugaggggugaauacgacagaaaagguucgcugcagcacugcuucacauccauagaagaaagagaagguuuauggaaagaacgugcaagccggacugaacgcuacaggaaacuggcuucaaacaaaaucaggucuaacagacagaugcguaaugccucuucugaagagaucgaaacgauauuagacaagcguuugagcaacugccgcaacgaauaccagaaaagcgagaagauaauucgccgauacaggguacaggaugcccugcucuucuuauuggcaaagaagacucugacggaacuggcggauuucgacggcgagagauucaagcugaaagagauuaugccugacgcagaaaagggaauccugucugagauuaugccuaugucauucacuuuugaaaagggcggcaagauauauaccauaacaucgggagguaugaaguugaaaaacuauggugauuucuucgucuuggcaagcgacaagagaaucggcaacuuguuagaacuuguuggcuccaacacuguauccaaggaggacaucauggaagaauucaagaaguaugaccaaugccgaccugaaauaucgagcaucguauucaacuuagagaaaugggcauucgauacuuauccugaguugccggcgagaguugacagaaaagaaaaaguugauuucuggagcaucuuagauguucucucaaacaacaaggauaucaauaaugagcaaaguuacauauugcgaaaaaucaggaaugcuuucgaucacaacaacuauccagacaaagguauuguugagauaaaggcuuugccugaaauugccaugagcauaaagaaagcauuuggagaauaugccaucaugaaauag

SEQ ID NO: 11112 - RNA, 3438 nt, Artificial Sequence
  Cas13b variant__Psychroflexus torquis__WP_015024765.1__Cas13b
auggaaaguauuauagguuuaggguuaucauucaauccguacaaaacggcugacaaacacuauuuuggaaguuuuuuaaauuuaguugagaacaauuugaacgcuguuuuugcagaauuuaaagaacguauaucauauaaagcuaaagaugaaaauauuucaaguuuaauagaaaagcauuuuauugauaauauguccauuguugauuaugaaaagaaaauuucgauuuuaaauggauaucugcccauuauagacuuuuuagaugaugaauuagaaaauaaccuaaacacaagaguuaagaacuuuaaaaagaacuuuaucaucuuggcagaagcaauagaaaagcuaagagacuacuacacucauuuuuaucaugauccuauaacauuugaagauaacaaagaaccuuuauuagaauuacuagacgagguucuuuuaaaaacaauuuuggaugucaagaaaaaauauuuaaaaacugauaaaacaaaagagauucuuaaagauucuuuaagagaagaaauggaccuccuaguuaucagaaaaaccgaugaauuaagagagaaaaagaaaaccaauccuaaaauucaacauacagauucuucacaaauuaaaaauucuauauuuaaugaugcuuuccaaggcuuauuauaugaggauaaaggaaauaacaagaaaacucaagucagucauagagcaaaaacaagauuaaacccaaaagacauacacaagcaagaggaaagggauuucgaaauuccucuuucuacuaguggauuaguuuuucugaugucacuuuucuuauccaaaaaagagauagaagauuuuaaaucaaauauuaaaggguuuaagggaaaaguagucaaagacgagaaucacaauagucuuaaauacauggcuacacauagaguguauucuauucuugcauuuaaagguuuaaaauaccgcauaaaaacagacacuuuuaguaaagaaacauuaaugaugcaaaugauagaugaacuuaguaaaguuccagauugugucuaucaaaauuuaagugaaaccaaacaaaaagauuuuauagaagauuggaaugaauauuuuaaagacaacgaagaaaauacagaaaaucuugaaaacucgcgugucguucacccaguaaucagaaaacgcuaugaggauaaauucaauuauuuugcaauccgauuuuuagaugaauuugccaauuuuaaaacgcucaaguuucaaguuuuuauggguuacuauauccacgaccaaagaacaaaaacaauuggaaccacaaauaucacaacugaacgaacgguaaaagaaaaaaucaacguuuuugguaaguuaucaaaaauggauaaccuuaaaaaacacuuuuuuucucagcuaucggaugaugaaaauacagauugggaauucuucccaaauccuagcuauaauuuccuuacccaagcagacaacucaccugcaaauaauauuccgauuuauuuggaacuaaagaaccaacaaaucauuaaagaaaaggaugccauaaaagcagaaguuaaucaaacacaaaacaggaauccuaauaaaccuuccaaaagagauuugcuaaacaagauuuuaaaaacauacgaagauuuucaucaaggagacccaacugcuauucuaaguuuaaaugaaauuccugcuuuacuucaucuauuuuuaguaaaaccuaauaauaaaacaggucagcaaauugagaacauaauuaggaucaagauugaaaaacaauuuaaagcuaucaaccauccaucuaaaaacaauaaagggauuccuaaaucucuauuugcagauacaaacguaagaguuaaugccauuaagcugaaaaaagauuuggaagcagagcuagacauguugaauaaaaagcauauugcuuucaaagaaaaccaaaaggcuucaaguaauuaugauaaguuauuaaaagagcaucaauucaccccaaaaaauaaaagaccagaguuaagaaaguauguuuuuuacaagucugaaaaaggcgaagaagcaacuuggcuugcuaaugauaucaaaagauuuaugccaaaagacuuuaaaacaaaauggaaaggaugccagcauagugaacugcaaagaaaguuagcuuuuuacgauaggcauaccaaacaagacaucaaagagcuuuuaucugguugugaguuugaccauucucuuuuagacauaaaugcauauuuucaaaaagauaacuuugaagauuucuucucuaaauaucuagaaaacagaauagaaacguuggaggguguuuuaaaaaaacuccaugacuuuaaaaaugagccuacaccucuaaagggaguuuuuaaaaauugcuuuaaauuuuuaaaacgacaaaacuauguaacugaaaguccagaaaucauuaaaaaaagaauuuuagccaaacccaccuuuuugccuagagguguuuuugaugaaagaccuacaaugaaaaaaggaaaaaauccuuuaaaagauaagaaugaguuugcggagugguuuguugaauaccuggagaauaaggauuaucaaaaauuuuauaaugcugaggaauaccgaaugagagaugcugauuuuaaaaaaaaugcagucaucaaaaaacaaaaacugaaagacuuuuauacgcuacaaauggucaacuauuuguugaaggaagucuuugggaaagaugagaugaacuugcagcuuucagagcuauuucaaacuagacaagagcgucugaaacugcaagguauugcuaaaaaacaaaugaauaaagaaacgggggauaguagugaaaacacuaggaaccaaacuuauaucuggaauaaagauguacccguuuccuuuuuuaacggcaaaguaacuauagauaaaguaaaacuaaaaaauauuggaaaauauaaaagauacgaacgugaugaaaggguaaaaacauuuauuggcuacgaaguagaugaaaaauggaugauguaucuaccacacaauuggaaagacagauacaguguaaaacccaucaauguaauagacuuacaaauacaggaauaugaagaaauaagaagucaugaauuauuaaaagaaauacagaaucuugaacaguacauuuaugaucauacaacagacaaaaauauuuuauuacaagauggaaaucccaauuuuaaaauguauguucugaaugggcuuuuaauaggcaucaaacaaguaaauauacccgauuuuauaguguuaaagcagaauacuaacuuugauaaaauugauuuuacaggcauagcaucuuguagcgaacuugaaaaaaagacuaucauuuuaauagccauaagaaauaaguuugcucacaaccaauugccaaacaaaaugauauacgauuuagcaaaugaauuucuuaaaauagaaaaaaaugaaaccuaugcuaacuauuauuuaaagguuuuaaagaaaaugauuucagauuuagcauag

SEQ ID NO: 11113 - RNA, 2847 nt, Artificial Sequence
  Cas13b variant__Riemerella anatipestifer__WP_049354263.1__Cas13b
auguuuuuuucauuucauaaugcacaacggguuauuuuuaaacaucuuuacaaagccuuugaugcuucuuuacgaaugguaaaagaggacuacaaagcccacuuuaccgucaaccucacucgggacuuugcccaucuaaacagaaaagguaaaaacaagcaagacaacccugacuucaaccgcuaccgcuucgaaaaagacggcuuuuuuacagaaucagggcuauuguuuuucacuaaucuauuuuuggauaaacgcgaugccuacuggaugcugaaaaaagucagugguuuuaaagccagucauaaacaaagagaaaaaaugaccaccgaaguguuuugcagaagccgcauacuccuuccuaaauuaagguuagagagccgauacgaccauaaccaaaugcucuuggauaugcuuucugaacugagccguugcccuaaacugcucuaugaaaaacucuccgaagagaauaaaaaacauuuucagguagaagcugauggcuuuuuggacgaaauugaggaagaacaaaacccuuuuaaagauaccuugaucagacaucaagaccguuucccuuauuuugcucuacgcuauuuagaccucaaugagucuuuuaaguccauaagguuucaaguggauuuaggcacuuaccauuacuguauuuacgacaagaaaauaggcgaugaacaagagaaacgccaccugacccgaacccuauugagcuucgguaggcuacaagauuucacagagauaaaucguccucaagaguggaaggcucucaccaaagaccuugacuauaaagagacuuccaaucagccauuuauuaguaaaaccacuccgcacuaccacauuaccgauaacaaaaucggcuuccgcuuaggaacuucuaaagaguuguacccuucguuggagauaaaagacggugccaaccgcauagccaaauaucccuauaauuccgguuuuguagcucaugcuuuuaucaguguccacgaauuguuaccucugauguucuaccagcauuuaacugguaaaucggaagacuuguugaaggaaaccguuagacauauccaaaggauuuacaaagacuuugaagaagaacgcaucaacacgauugaagauuuagaaaaagccaaccaaggucgccuuccuuuaggcgccuuuccaaaacaaauguugggcuuacugcaaaauaaacaacccgaccuuucggaaaaagccaaaaucaaaauagaaaaacuaauagccgaaaccaagcugcucucccaccgccucaacaccaaacuaaaaagcucuccaaagcucggaaagagacgagaaaagcucaucaagacaggcguauuggcugauuggcuggugaaagacuuuaugcgauuucagccuguggcuuacgaugcucaaaaccaaccuauaaagagcaguaaagccaacagcacggaauuuugguuuauccgaagagcauuagccuuguacggaggcgaaaagaacagacuagaaggcuacuuuaagcaaaccaaccucaucggaaauaccaacccgcacccguuccuaaauaaauucaauuggaaagcguguaggaaucugguggacuuuuaccaacaguaucuggaacaaagagaaaaauucuuagaagcuaucaaaaaccaaccuugggagccguaccaguacugccuacuucuuaaaauaccgaaagagaauagaaaaaaucugguuaaagguugggaacaagggggcauuagucugccaagagggcuguuuaccgaagcgauuagagagacccuuucggaagaccucaugcuauccaaaccuauuagaaaggagauuaaaaaacacggcagaguaggcuuuaucuccagagccauuacacuguacuuuaaggaaaaguaccaagacaagcaccagaguuuuuacaaccuuucguacaaguuagaagccaaggcaccgcugcuaaagagggaagaacacuacgaauauuggcaacagaacaaaccccaaagcccuacggagucucagaggcuggaguugcauacuucugaccgauggaaagacuaccuccucuacaaacgcuggcaacauuuggagaagaaacuuaggcucuacagaaaccaagauguuaugcuuuggcugaugaccuuagagcugacaaaaaaucacuuuaaagaacugaaucugaacuaccaccagcucaaauuagagaacuuggcggucaauguucaggaagcagacgccaagcucaauccgcugaaccaaaccuugccuaugguguugccuguaaaagucuauccugccacugcauuuggggaaguacaauaccauaaaacaccgauaagaaccgucuauauccgagaagagcauaccaaagcccuuaaaauggggaacuuuaaagccuugguaaaagaccgccgucuuaacgguuuguuuagcuuuaucaaagaggagaacgauacccaaaagcacccgauuagucagcucagauuaaggcgggaguuggagauuuaccaaucgcuaaggguagaugccuuuaaagaaacccugagcuuggaagagaaacuacugaacaaacacaccagucucuccaguuuagagaaugaguuucgugcauuauuggaagaauggaagaaagaguaugcugcuucauccaugguuacggacgagcauaucgccuuuaucgccucgguacgcaaugccuucugccauaaccaauacccuuuuuacaaggaagcccuccacgcuccuauuccgcucuuuacgguugcccagccaaccaccgaagaaaaagacggcuuaggcauugccgaagcauugcuaaaagucuugcgugaauauugcgaaauuguuaaaucucaaauuuag

SEQ ID NO: 11114 - RNA, 3288 nt, Artificial Sequence
  Cas13b variant__Riemerella anatipestifer__WP_004919755.1__Cas13b
auggaaaaaccuuuacuaccgaauguuuacacacugaaacacaaguucuuuuggggagccuuccuuaacauugcaaggcauaaugcuuuuaucaccaucugccauaucaacgaacaguuggggcuuaagaccccuucaaaugaugacaaaaucguagauguugucugugagacauggaauaacauacucaacaacgaccacgauuuacucaaaaagagccaacuaacggaacuuauccuaaaacacuucccguuccugacggcaaugugcuaccacccuccuaaaaaagagggaaaaaagaaggggcaccaaaaagagcagcagaaagagaaagaaagcgaagcccaaucucaagccgaggcucuuaauccaagcaaauugauugaggcguuggaaauccuuguaaaucaacuccacagucuuaggaacuacuauagccacuacaaacacaaaaaacccgaugcagaaaaagauauuuuuaaacaucuuuacaaagccuuugaugcuucuuuacgaaugguaaaagaggacuacaaagcccacuuuaccgucaaccucacucgggacuuugcccaucuaaacagaaaagguaaaaacaagcaagacaacccugacuucaaccgcuaccgcuucgaaaaagacggcuuuuuuacagaaucagggcuauuguuuuucacuaaucuauuuuuggauaaacgcgaugccuacuggaugcugaaaaaagucagugguuuuaaagccagucauaaacaaagagaaaaaaugaccaccgaaguguuuugcagaagccgcauacuccuuccuaaauuaagguuagagagccgauacgaccauaaccaaaugcucuuggauaugcuuucugaacugagccguugcccuaaacugcucuaugaaaaacucuccgaagagaauaaaaaacauuuucagguagaagcugauggcuuuuuggacgaaauugaggaagaacaaaacccuuuuaaagauaccuugaucagacaucaagaccguuucccuuauuuugcucuacgcuauuuagaccucaaugagucuuuuaaguccauaagguuucaaguggauuuaggcacuuaccauuacuguauuuacgacaagaaaauaggcgaugaacaagagaaacgccaccugacccgaacccuauugagcuucgguaggcuacaagauuucacagagauaaaucguccucaagaguggaaggcucucaccaaagaccuugacuauaaagagacuuccaaucagccauuuauuaguaaaaccacuccgcacuaccacauuaccgauaacaaaaucggcuuccgcuuaggaacuucuaaagaguuguacccuucguuggagauaaaagacggugccaaccgcauagccaaauaucccuauaauuccgguuuuguagcucaugcuuuuaucaguguccacgaauuguuaccucugauguucuaccagcauuuaacugguaaaucggaagacuuguugaaggaaaccguuagacauauccaaaggauuuacaaagacuuugaagaagaacgcaucaacacgauugaagauuuagaaaaagccaaccaaggucgccuuccuuuaggcgccuuuccaaaacaaauguugggcuuacugcaaaauaaacaacccgaccuuucggaaaaagccaaaaucaaaauagaaaaacuaauagccgaaaccaagcugcucucccaccgccucaacaccaaacuaaaaagcucuccaaagcucggaaagagacgagaaaagcucaucaagacaggcguauuggcugauuggcuggugaaagacuuuaugcgauuucagccuguggcuuacgaugcucaaaaccaaccuauaaagagcaguaaagccaacagcacggaauuuugguuuauccgaagagcauuagccuuguacggaggcgaaaagaacagacuagaaggcuacuuuaagcaaaccaaccucaucggaaauaccaacccgcacccguuccuaaauaaauucaauuggaaagcguguaggaaucugguggacuuuuaccaacaguaucuggaacaaagagaaaaauucuuagaagcuaucaaaaaccaaccuugggagccguaccaguacugccuacuucuuaaaauaccgaaagagaauagaaaaaaucugguuaaagguugggaacaagggggcauuagucugccaagagggcuguuuaccgaagcgauuagagagacccuuucggaagaccucaugcuauccaaaccuauuagaaaggagauuaaaaaacacggcagaguaggcuuuaucuccagagccauuacacuguacuuuaaggaaaaguaccaagacaagcaccagaguuuuuacaaccuuucguacaaguuagaagccaaggcaccgcugcuaaagagggaagaacacuacgaauauuggcaacagaacaaaccccaaagcccuacggagucucagaggcuggaguugcauacuucugaccgauggaaagacuaccuccucuacaaacgcuggcaacauuuggagaagaaacuuaggcucuacagaaaccaagauguuaugcuuuggcugaugaccuuagagcugacaaaaaaucacuuuaaagaacugaaucugaacuaccaccagcucaaauuagagaacuuggcggucaauguucaggaagcagacgccaagcucaauccgcugaaccaaaccuugccuaugguguugccuguaaaagucuauccugccacugcauuuggggaaguacaauaccauaaaacaccgauaagaaccgucuauauccgagaagagcauaccaaagcccuuaaaauggggaacuuuaaagccuugguaaaagaccgccgucuuaacgguuuguuuagcuuuaucaaagaggagaacgauacccaaaagcacccgauuagucagcucagauuaaggcgggaguuggagauuuaccaaucgcuaaggguagaugccuuuaaagaaacccugagcuuggaagagaaacuacugaacaaacacaccagucucuccaguuuagagaaugaguuucgugcauuauuggaagaauggaagaaagaguaugcugcuucauccaugguuacggacgagcauaucgccuuuaucgccucgguacgcaaugccuucugccauaaccaauacccuuuuuacaaggaagcccuccacgcuccuauuccgcucuuuacgguugcccagccaaccaccgaagaaaaagacggcuuaggcauugccgaagcauugcuaaaagucuugcgugaauauugcgaaauuguuaaaucucaaauuuag

SEQ ID NO: 11115 - RNA, 3288 nt, Artificial Sequence
  Cas13b variant__Riemerella anatipestifer__WP_064970887.1__Cas13b
auggaaaaaccuuuaccaccgaauguuuacacacugaaacacaaguucuuuuggggagccuuccuuaacauugcaaggcauaaugcuuuuaucaccauuugccauaucaacgaacaguuggggcuuacgaccccuccaaacgaugacaaaaucgcagauguugucugugggacauggaauaacauacucaacaacgaccacgauuuacucaagaagagccaacuaacggagcuuauccuaaaacacuucccguuccuugcggcaaugugcuaccacccuccuaaaaaagagggaaaaaagaaagguagccaaaaagagcagcagaaagagaaagaaaacgaagcccaaucgcaagccgaggcucuuaauccaagugaauugauuaagguauugaaaacccuuguaaagcaacuccgcacucuuagaaacuacuacagccaccacagccacaaaaaacccgaugcagaaaaagacauuuuuaagcaucuuuacaaagccuuugacgcuucuuuacgaaugguaaaagaggacuacaaagcccacuuuaccgucaaccucacucaggacuuugcccaucuaaacagaaaagguaagaacaagcaagacaacccugacuucgaccgcuaccgcuuugaaaaagacggcuuuuuuacagaaucagggcuauuguuuuucacuaaucuguucuuggacaaacgcgaugccuacuggaugcugaaaaaagucagugguuuuaaagccagucauaaacaaagcgaaaaaaugacuaccgaaguguuuugcagaagccguauacuccuuccuaaacuaagguuagagagccgauacgaccauaaccaaaugcucuuggauaugcuuucugaacugagccguuacccuaaacugcucuaugaaaaacucuccgaagaggauaaaaaacgcuuucagguagaagcugauggcuuuuuggacgaaauugaggaagaacaaaacccuuucaaagauaccuuaaucaggcaucaagaccguuucccuuauuuugcucuacgcuauuuagaccucaaugagucuuuuaaguccauaagauuucaaguggauuuaggcacuuaccauuacuguauuuacgacaagaaaauaggcgaugaacaagagaaacgccaccugacccgaacucuauugagcuucgguaggcuacaagauuucacagagauaaaccguccccaagaauggaaagcucucaccaaagaccucgacuauaaagaaacuuccaaacagccauuuauuaguaaaaccacuccgcacuaccacauuaccgauaacaaaaucggcuuccgcuuaggaacuucuaaagaguuguacccuucguuggagguaaaagacggugccaaccgcauagcccaguacccuuauaauuccgauuuuguagcucaugcuuuuaucaguguccacgaauuguuaccucugauguucuaccagcauuuaacugguaaaucggaagacuuguugaaggaaaccguuagacauauccaaaggauuuacaaagacuuugaagaagaacgcaucaacacgauugaagauuuagaaaaagccaaccaaggucgccuuccuuuaggagccuuuccaaaacaaauguugggcuuacugcaaaauaaacaacccgaccuuucggaaaaagccaaaaucaaaauagaaaaacuaauagccgaaaccaagcugcucucccaucgccucaauaccaaacuaaaaagcucuccaaagcucggaaagagacgagaaaagcucaucaagacaggcguauuggcugauuggcuggugaaagacuuuaugcgauuucagccuguggcuuacgaugcucaaaaucaaccuauagagagcaguaaagccaacagcacagaauuucagcuuauccaaagagcauuagccuuguacggaggcgaaaagaaccgauuagaaggcuacuuuaaacaaaccaaccucaucggaaauaccaacccgcacccguuccuaaauaaauucaauuggaaagcgugcagaaauuugguggacuuuuaccaacaguaucuggaacaaagagaaaaauucuuagaagcuaucaaaaaccaaccuugggaaccauaccaguacugccuacuucuuaaaauaccgaaagagaauagaaaaaaucugguuaaagguugggaacaagggggcauuagccugccaagaggacuguuuaccgaagcaauuagagagacccuuucaaaagaccucacgcuguccaaaccuauuagaaaggagauuaaaaaacacggcagagugggcuuuaucuccagagccauuacgcuguacuuuagggaaaaguaccaagacgaccaccagaguuuuuacgaccuuccguacaaguuagaagccaaggcaucgccgcuaccgaagaaagaacacuacgaauauuggcagcagaacaaaccccaaagcccuacggaauugcagaggcuggaguugcauaccucugaccgauggaaagacuaccuccucuacaaacgcuggcaacauuuggagaagaaacuuaggcucuacagaaaccaagauguuaugcuuuggcugaugaccuuagagcugacaaaaaaucacuuuaaagaacugaaucugaacuaccaccagcucaaauuagagaacuuggcggucaauguucaggaagcagacgccaaacucaauccgcugaaccaaaccuugccuaugguguugccuguaaaagucuauccugccacugcauuuggggaaguacaauaccaagaaacaccgauaagaaccgucuauauccgagaagagcagacuaaagcccuuaaaauggggaacuuuaaagccuugguaaaagaccgccgucuuaacgguuuguuuagcuuuaucaaagaggagaacgacacccaaaagcacccgauuagucagcucagacuaaggcgggaguuggagauuuaccagucgcuaaggguagaugccuuuaaagaaaccuugaacuuggaagagaaacuacugaagaaacacaccagccucuccagcguagagaauaaguuccgaauauuguuggaagaauggaagaaagaguaugcugcuuccuccaugguuacggacgagcauaucgccuuuaucgccucgguacgcaaugccuucugccauaaccaauacccuuuuuaugaggaagcccuccacgcuccuauuccgcucuuuacgguugcccagcaaaccaccgaagaaaaagacggcuuaggcauugccgaagcauugcuaagagucuugcgugaauauugcgaaauuguuaaaucucaaauuuag

SEQ ID NO: 11116 - RNA, 2853 nt, Artificial Sequence
  Cas13b variant__Riemerella anatipestifer__WP_061710138.1__Cas13b
auguuuuuuucauuucauaaugcacaacggguuauuuuuaaacaucuuuacaaagccuuugaugcuucuuuacgaaugguaaaagaggacuacaaagcccacuuuaccgucaaccucacucgggacuuugcccaucuaaacagaaaagguaaaaacaagcaagacaacccugacuucaaccgcuaccgcuucgaaaaagacggcuuuuuuacagaaucagggcuauuguuuuucacuaaucuguucuuggauaaacgcgaugccuacuggaugcugaaaaaagucagugguuuuaaagccagucauaaacaaagcgaaaaaaugacuaccgaaguguuuugcagaagccguauacuccuuccuaaacuaagguuagagagccgauacgaccauaaccaaaugcucuuggauaugcuuucugaacugagccguugcccuaaacugcucuaugaaaaacucuccgaaaaggauaaaaaauguuuucagguagaagcugauggcuuuuuggacgaaauugaggaagaacaaaacccuuuuaaagacaccuuaaucaggcaucaagaccguuucccuuauuucgcucuacgcuauuuagaccucaaugagucuuuuaaguccauaagguuucaaguggauuuaggcacuuaccauuacuguauuuacgacaagaaaauaggcuaugaacaagagaaacgccaccugacccgaacccuauugaacuucgguaggcugcaagauuucacagagauaaaccguccccaagaguggaaggcucucaccaaagaccucgacuauaacgaaacuuccaaucaaccauuuauuaguaaaaccacuccgcacuaccacauuaccgauaacaaaaucggcuuccgcuuaagaacuucuaaagaguuguacccuucguuggagguaaaagacggugccaaccgcauagccaaauaucccuauaauuccgauuuuguggcucaugcuuuuaucaguaucaguguccacgaauuguuaccucugauguucuaccagcauuuaacugguaaaucggaagacuuguugaaagaaaccguuaggcauauccaaaggauuuacaaagacuuugaagaagaacgcaucaacacgauugaggauuuagaaaaagccaaccaaggucgccuuccuuuaggagccuuuccaaaacaaauguugggcuuacugcaaaacaaacaacccgaccuuucggaaaaagccaaaaucaaaauagaaaaacuaauagccgaaaccaaacuccuuucccaccgccucaauaccaagcuaaaaagcucuccaaagcucggaaagagacgagaaaagcucaucaagacgggcguauuggcugauuggcuggugaaagacuuuaugcgauuucagccugugguuuacgaugcucaaaaccaaccuauaaagagcaguaaagccaacagcacggagucucggcuuauccgaagagcauuagccuuguauggaggcgaaaagaaccgacuggaaggcuacuuuaaacaaaccaaccucaucggaaauaccaacccgcacccuuuccuaaauaaauucaauuggaaagcgugcagaaauuugguggacuuuuaccaacaguaucuggaacaaagagaaaaauucuuagaagcuaucaaacaccaaccuugggaaccguaccaguacugccuacuucuuaaaguaccgaaagagaauagaaaaaaucugguuaaagguugggaacaaggaggcauuagccugccaagagggcuguuuaccgaagcgauuagagagacccuuucaaaagaccucacgcuauccaaaccuauuagaaaggagauuaaaaaacacggcagagugggcuuuaucuccagagccauuacacuguacuuuaaggaaaaguaccaagacaagcaccagaguuuuuacaaccuuucguacaaguuagaagccaaggcaccgcugcuaaagaaggaagaacacuacgaauauuggcaacagaacaaaccccaaagcccuacggagucgcagaggcuggaguugcauaccucugaccgauggaaagacuaccuccucuacaaacgcuggcaacauuuggagaaaaaacuuaggcucuacagaaaccaagauauuaugcuuuggcugaugaccuuagagcugacaaaaaaucacuuuaaagaacugaaucugaacuaccaccagcucaaauuagagaacuuggcggucaauguucaggaagcagacgccaaacucaauccgcugaaccaaaccuugccuaugguguuaccuguaaaagucuauccuaccacugcauuuggggaaguacaauaccaugaaacaccuauaagaaccgucuauauccgagaagagcagacuaaagcccuuaaaauggggaacuuuaaagccuugguaaaagaccgccaucuuaacgguuuguuuaguuuuaucaaagaggagaacgacacccaaaagcacccgauuagucagcucagauuaaggcgggaguuggagauuuaccagucgcuaaggguagaugccuuuaaagaaaccuugagcuuggaagagaaacuacugaauaaacacgccagccucuccaguuuagagaaugaguuucguacauuguuggaagaauggaaaaagaaguaugcugcuuccuccaugguuacggacaagcauaucgccuuuaucgccucgguacgcaaugccuucugccauaaccaauacccuuuuuacaaggaaacccuccacgcuccuauucugcucuuuacgguugcccagccaaccaccgaagaaaaagacggcuuagguauugccgaagcguugcuaagagucuugcgugaauauugcgaaauuguuaaaucucaaauuuag

SEQ ID NO: 11117 - RNA, 2850 nt, Artificial Sequence
  ARMAN Cas9 variant__Candidatus Micrarchaeum acidiphilum__OJI07263.1__Cas9
augagagacucuauuacugcaccuagauacagcuccgcucuugccgccagaauaaaggaguuuaauucugcuuucaaguuaggaaucgaccuaggaacaaaaaccggcggcguagcacugguaaaagacaacaaagugcugcucgcuaagacauuccucgauuaccauaaacaaacacuggaggaaaggaggauccauagaagaaacagaaggagcaggcuagccaggcggaagaggauugcucggcugcgaucauggauacucagacagaagauuuauggcaagcagcuuccugacccauacaaaaucaaaaaaaugcaguugccuaaugguguacgaaaaggggaaaacuggauugaccugguaguuucuggacgggaccuuucaccagaagccuucgugcgugcaauaacucugauauuccaaaagagagggcaaagauaugaagaaguggccaaagagauagaagaaaugaguuacaaggaauuuaguacucacauaaaagcccugacauccguuacugaagaagaauuuacugcucuggcagcagagauagaacggaggcaggaugugguugacacagacaaggaggccgaacgcuauacccaauugucugaguugcucuccaaggucucagaaagcaaaucugaaucuaaagacagagcgcagcguaaggaggaucucggaaagguggugaacgcuuucugcagugcucaucguaucgaagacaaggauaaaugguguaaagaacuuaugaaauuacuagacagaccagucagacacgcuagguuccuuaacaaaguacugauacguugcaauaucugcgauagggcaaccccuaagaaauccagaccugacgugagggaacugcuauauuuugacacaguaagaaacuucuugaaggcuggaagaguggagcaaaacccagacguuauuaguuacuauaaaaaaauuuauauggaugcagaaguaaucagggucaaaauucugaauaaggaaaagcugacugaugaggacaaaaagcaaaagaggaaauuagcgagcgaacuuaacagguacaaaaacaaagaauacgugacugaugcgcagaagaagaugcaagagcaacuuaagacauugcuguucaugaagcugacaggcaggucuagauacugcauggcucaucuuaaggaaagggcagcaggcaaagauguagaagaaggacuucauggcguugugcagaaaagacacgacaggaacauagcacagcgcaaucacgacuuacgugugauuaaucuuauugagagucugcuuuucgaccaaaacaaaucgcucuccgaugcaauaaggaagaacggguuaauguauguuacuauugaggcuccagagccaaagacuaagcacgcaaagaaaggcgcagcugugguaagggaucccagaaaguugaaggagaaguuguuugaugaucaaaacggcguuugcauauauacgggcuugcaguuagacaaauuagagauaaguaaauacgagaaggaccauaucuuuccagauucaagggauggaccaucuaucagggacaaucuuguacucacuacaaaagagauaaauucagacaaaggcgauaggaccccaugggaauggaugcaugauaacccagaaaaauggaaagcguucgagagaagagucgcagaauucuauaagaaaggcagaauaaaugagaggaaaagagaacuccuauuaaacaaaggcacugaauacccuggcgauaacccgacugagcuggcgcggggaggcgcccguguuaacaacuuuauuacugaauuuaaugaccgccucaaaacgcauggaguccaggaacugcagaccaucuuugagcguaacaaaccaauagugcagguagucaggggugaagaaacgcagcgucugcgcagacaauggaaugcacuaaaccagaauuucauaccacuaaaggacagggcaaugucguucaaccacgcugaagacgcagccauagcagcaagcaugccaccaaaauucuggagggagcagauauaccguacugcguggcacuuuggaccuaguggaaaugagagaccggacuuugcuuuggcagaauuggcgccacaauggaaugacuucuuuaugacuaagggcgguccaauaauagcagugcugggcaaaacgaaguauaguuggaagcacagcauaauugaugacacuauauacaagccauucagcaaaagugcuuacuauguugggauauacaaaaagccgaacgccaucacguccaaugcuauaaaagucuuaaggccaaaacucuuaaauggcgaacauacaaugucuaagaaugcaaaguauuaucaucagaagauugguaaugagcgcuuccucaugaaaucucagaaagguggaucgauaauuacaguaaaaccacacgacggaccggaaaaagugcuucaaaucagcccuacauaugaaugcgcaguccuuacuaagcaugacgguaaaauaauagucaaauuuaaaccaauaaagccgcuacgggacauguaugcccgcggugugauuaaagccauggacaaagagcuugaaacaagccucucuagcaugaguaaacacgcuaaguacaaggaguuacacacucaugauaucauauaucugccugcuacaaagaagcacguagauggcuacuucauaauaaccaaacuaagugcgaaacauggcauaaaagcacuccccgaaagcaugguuaaagucaaguauacucaaauugggagugaaaacaauagugaagugaagcuuaccaaaccaaaaccagagauaacuuuggauagugaagauauuacaaacauauauaauuucacccgcuaa

SEQ ID NO: 11118 - RNA, 2904 nt, Artificial Sequence
  ARMAN Cas9 variant__Candidatus Parvarchaeum acidiphilum__APG80630.1__Cas9
auguuaggcuccagcagguaccuccguuauaaccuaaccucguuugaaggcaaggagccauuuuuaauaaugggauauuacaaagaguauaauaaggaauuaaguuccaaagcucaaaaagaauuuaaugaucaaauuucugaauuuaauucguauuacaaacuagguauagaucucggagauaaaacaggaauugcaaucguaaagggcaacaaaauaauccuagcaaaaacacuaauugauuugcauucccaaaaauuagauaaaagaagggaagcuagaagaaauagaagaacucggcuuuccagaaagaaaaggcuugcgagauuaagaucguggguaaugcgucagaaaguuggcaaucaaagacuucccgauccauauaaaauaaugcaugacaauaaguacuggucuauauauaauaagaguaauucugcaaauaaaaagaauuggauagaucuguuaauccacaguaacucuuuaucagcagacgauuuuguuagaggcuuaacuauaauuuucagaaaaagaggcuauuuagcauuuaaguaucuuucaagguuaagcgauaaggaauuugaaaaauacauagauaacuuaaaaccaccuauaagcaaauacgaguaugaugaggauuuagaagaauuaucaagcaggguugaaaauggggaaauagaggaaaagaaauucgaaggcuuaaagaauaagcuagauaaaauagacaaagaaucuaaagacuuucaaguaaagcaaagagaagaaguaaaaaaggaacuggaagacuuaguugauuuguuugcuaaaucaguugauaauaaaauagauaaagcuagguggaaaagggagcuaaauaauuuauuggauaagaaaguaaggaaaauacgguuugacaaccgcuuuauuuugaagugcaaaauuaagggcuguaacaagaauacuccaaagaaagagaaggucagagauuuugaauugaagaugguuuuaaauaaugcuagaagcgauuaucagauuucugaugaggauuuaaacucuuuuagaaaugaaguaauaaauauauuucaaaagaaggaaaacuuaaagaaaggagagcugaaaggaguuacuauugaagauuugagaaagcagcuuaauaaaacuuuuaauaaagccaagauuaaaaaagggauaagggagcagauaaggucuaucguguuugaaaaaauuaguggaaggaguaaauucugcaaagaacaucuaaaagaauuuucugagaagccggcuccuucugacaggauuaauuaugggguuaauucagcaagagaacaacaugauuuuagagucuuaaauuucauagauaaaaaaauauucaaagauaaguugauagaucccucaaaauugagguauauaacuauugaaucuccagaaccagaaacagagaaguuggaaaaaggucaaauaucagagaagagcuucgaaacauugaaagaaaaauuggcuaaagaaacaggugguauugauauauacacuggugaaaaauuaaagaaagacuuugaaauagagcacauauucccaagagcaaggauggggccuucuauaagggaaaacgaaguagcaucaaaucuggaaacaaauaaggaaaaggccgauagaacuccuugggaaugguuugggcaagaugaaaaaagauggucagaguuugagaaaagaguuaauucucuuuauaguaaaaagaaaauaucagagagaaaaagagaaauuuuguuaaauaagaguaaugaauauccgggauuaaacccuacagaacuaaguagaauaccuaguacgcugagcgacuucguugagaguauaagaaaaauguuuguuaaguauggcuaugaagagccucaaacuuugguucaaaaaggaaaaccgauaauacaaguuguuagaggcagagacacacaagcuuugagguggagauggcaugcauuagauaguaauauaauaccagaaaaggacaggaaaaguucauuuaaucacgcugaagaugcaguuauugccgccuguaugccaccuuacuaucucaggcaaaaaauauuuagagaagaagcaaaaauaaaaagaaaaguaagcaauaaggaaaaggaaguuacacggccugacaugccuacuaaaaagauagcuccgaacuggucggaauuuaugaaaacuagaaaugagccgguuauugaaguaauaggaaaaguuaagccaagcuggaaaaacagcauaauggaucaaacauuuuauaaauaucuuuugaagccauuuaaagauaaccugauaaaaauacccaacguuaaaaauacauacaaguggauaggaguuaauggacaaacugauucauuaucccucccgaguaaggucuuaucuaucucuaauaaaaagguugauucuucuacaguucuucuugugcaugauaagaagggugguaagcggaauuggguaccuaaaaguauaggggguuuguugguauauauaacuccuaaagacgggccgaaaagaauaguucaaguaaagccagcaacucaggguuuguuaauauauagaaaugaagauggcagaguagaugcuguaagagaguucauaaauccagugauagaaauguauaauaauggcaaauuggcauuuguagaaaaagaaaaugaagaagagcuuuugaaauauuuuaauuugcuggaaaaaggucaaaaauuugaaagaauaagacgguaugauaugauaaccuacaauaguaaauuuuacuauguaacaaaaauaaacaagaaucacagaguuacuauacaagaagagucuaagauaaaagcagaaucagacaaaguuaaguccucuucaggcaaagaguauacucguaaggaaaccgaggaauuaucacuucaaaaauuagcggaauuaauuaguauauaa

SEQ ID NO: 11119 - RNA, 2850 nt, Artificial Sequence
  ARMAN Cas9 variant__Candidatus Micrarchaeum sp.__OJT94500.1__Cas9
augagagacucuauuacugcaccuagauacagcuccgcucuugccgccagaauaaaggaguuuaauucugcuuucaaguuaggaaucgaccuaggaacaaaaaccggcggcguagcacugguaaaagacaacaaagugcugcucgcuaagacauuccucgauuaccauaaacaaacacuggaggaaaggaggauccauagaagaaacagaaggagcaggcuagccaggcggaagaggauugcucggcugcgaucauggauacucagacagaagauuuauggcaagcagcuuccugacccauacaaaaucaaaaaaaugcaguugccuaaugguguacgaaaaggggaaaacuggauugaccugguaguuucuggacgggaccuuucaccagaagccuucgugcgugcaauaacucugauauuccaaaagagagggcaaagauaugaagaaguggccaaagagauagaagaaaugaguuacaaggaauuuaguacucacauaaaagcccugacauccguuacugaagaagaauuuacugcucuggcagcagagauagaacggaggcaggaugugguugacacagacaaggaggccgaacgcuauacccaauugucugaguugcucuccaaggucucagaaagcaaaucugaaucuaaggacagagcgcagcguaaggaggaucucggaaagguggugaacgcuuucugcagugcucaucguaucgaagacaaggauaaaugguguaaagaacuuaugaaauuacuagacagaccagucagacacgcuagguuccuuaacaaaguacugauacguugcaauaucugcgauagggcaaccccuaagaaauccagaccugacgugagggaacugcuauauuuugacacaguaagaaacuucuugaaggcuggaagaguggagcaaaacccagacguuauuaguuacuauaaaaaaauuuauauggaugcagaaguaaucagggucaaaauucugaauaaggaaaagcugacugaugaggacaaaaagcaaaagaggaaauuagcgagcgaacuuaacagguacaaaaacaaagaauacgugacugaugcgcagaagaagaugcaagagcaacuuaagacauugcuguucaugaagcugacaggcaggucuagauacugcauggcucaucuuaaggaaagggcagcaggcaaagauguagaagaaggacuucauggcguugugcagaaaagacacgacaggaacauagcacagcgcaaucacgacuuacgugugauuaaucuuauugagagucugcuuuucgacccaaacaaaucgcucuccgaugcaauaaggaagaacggguuaauguauguuacuauugaggcuccagagccaaagacuaagcacgcaaagaaaggcgcagcugugguaagggaucccagaaaguugaaggagaaguuguuugaugaucaaaacggcguuugcauauauacgggcuugcaguuagacaaauuagagauaaguaaauacgagaaggaccauaucuuuccagauucaagggauggaccaucuaucagggacaaucuuguacucacuacaaaagagauaaauucagacaaaggcgauaggaccccaugggaauggaugcaugauaacccagaaaaauggaaagcguucgagagaagagucgcagaauucuauaagaaaggcagaauaaaugagaggaaaagagaacuccuauuaaacaaaggcacugaauacccuggcgauaacccgacugagcuggcgcggggaggcgcccguguuaacaacuuuauuacugaauuuaaugaccgccucaaaacgcauggaguccaggaacugcagaccaucuuugagcguaacaaaccaauagugcagguagucaggggugaagaaacgcagcgucugcgcagacaauggaaugcacuaaaccagaauuucauaccacuaaaggacagggcaaugucguucaaccacgcugaagacgcagccauagcagcaagcaugccaccaaaauucuggagggagcagauauaccguacugcguggcacuuuggaccuaguggaaaugagagaccggacuuugcuuuggcagaauuggcgccacaauggaaugacuucuuuaugacuaagggcgguccaauaauagcagugcugggcaaaacgaaguauaguuggaagcacagcauaauugaugacacuauauacaagccauucagcaaaagugcuuacuauguugggauauacaaaaagccgaacgccaucacguccaaugcuauaaaagucuuaaggccaaaacucuuaaauggcgaacauacaaugucuaagaaugcaaaguauuaucaucagaagauugguaaugagcgcuuccucaugaaaucucagaaagguggaucgauaauuacaguaaaaccacacgacggaccggaaaaagugcuucaaaucagcccuacauaugaaugcgcaguccuuacuaagcaugacgguaaaauaauagucaaauuuaaaccaauaaagccgcuacgggacauguaugcccgcggugugauuaaagccauggacaaagagcuugaaacaagccucucuagcaugaguaaacacgcuaaguacaaggaguuacacacucaugauaucauauaucugccugcuacaaagaagcacguagauggcuacuucauaauaaccaaacuaagugcgaaacauggcauaaaagcacuccccgaaagcaugguuaaagucaaguauacucaaauugggagugaaaacaauagugaagugaagcuuaccaaaccaaaaccagagauaacuuuggauagugaagauauuacaaacauauauaauuucacccgcuaa

SEQ ID NO: 11120 - RNA, 2961 nt, Artificial Sequence
  CasX variant__Deltaproteobacteria bacterium__OGP07438.1__CasX
auggaaaagagaauaaacaagauacgaaagaaacuaucggccgauaaugccacaaagccugugagcaggagcggccccaugaaaacacuccuuguccgggucaugacggacgacuugaaaaaaagacuggagaagcgucggaaaaagccggaaguuaugccgcagguuauuucaaauaacgcagcaaacaaucuuagaaugcuccuugaugacuauacaaagaugaaggaggcgauacuacaaguuuacuggcaggaauuuaaggacgaccaugugggcuugaugugcaaauuugcccagccugcuuccaaaaaaauugaccagaacaaacuaaaaccggaaauggaugaaaaaggaaaucuaacaacugccgguuuugcauguucucaaugcggucagccgcuauuuguuuauaagcuugaacaggugagugaaaaaggcaaggcuuauacaaauuacuucggccgguguaauguggccgagcaugagaaauugauucuucuugcucaauuaaaaccugaaaaagacagugacgaagcagugacauacucccuuggcaaauucggccagagggcauuggacuuuuauucaauccacguaacaaaagaauccacccauccaguaaagccccuggcacagauugcgggcaaccgcuaugcaagcggaccuguuggcaaggcccuuuccgaugccuguaugggcacuauagccaguuuucuuucgaaauaucaagacaucaucauagaacaucaaaagguugugaaggguaaucaaaagagguuagagagucucagggaauuggcagggaaagaaaaucuugaguacccaucgguuacacugccgccgcagccgcauacgaaagaagggguugacgcuuauaacgaaguuauugcaaggguacguauguggguuaaucuuaaucuguggcaaaagcugaagcucagccgugaugacgcaaaaccgcuacugcggcuaaaaggauucccaucuuucccuguuguggagcggcgugaaaacgaaguugacugguggaauacgauuaaugaaguaaaaaaacugauugacgcuaaacgagauaugggacggguauucuggagcggcguuaccgcagaaaagagaaauaccauccuugaaggauacaacuaucugccaaaugagaaugaccauaaaaagagagagggcaguuuggaaaacccuaagaagccugccaaacgccaguuuggagaccucuugcuguaucuugaaaagaaauaugccggagacuggggaaaggucuucgaugaggcaugggagaggauagauaagaaaauagccggacucacaagccauauagagcgcgaagaagcaagaaacgcggaagacgcucaauccaaagccguacuuacagacuggcuaagggcaaaggcaucauuuguucuugaaagacugaaggaaauggaugaaaaggaauucuaugcgugugaaauccaacuucaaaaaugguauggcgaucuucgaggcaacccguuugccguugaagcugagaauagaguuguugauauaagcggguuuucuaucggaagcgauggccauucaauccaauacagaaaucuccuugccuggaaauaucuggagaacggcaagcgugaauucuaucuguuaaugaauuauggcaagaaagggcgcaucagauuuacagauggaacagauauuaaaaagagcggcaaauggcagggacuauuauauggcgguggcaaggcaaagguuauugaucugacuuucgaccccgaugaugaacaguugauaauccugccgcuggccuuuggcacaaggcaaggccgcgaguuuaucuggaacgauuugcugagucuugaaacaggccugauaaagcucgcaaacggaagaguuaucgaaaaaacaaucuauaacaaaaaaauagggcgggaugaaccggcucuauucguugccuuaacauuugagcgccgggaaguuguugauccaucaaauauaaagccuguaaaccuuauaggcguugaccgcggcgaaaacaucccggcgguuauugcauugacagacccugaagguuguccuuuaccggaauucaaggauucaucagggggcccaacagacauccugcgaauaggagaaggauauaaggaaaagcagagggcuauucaggcagcaaaggagguagagcaaaggcgggcuggcgguuauucacggaaguuugcauccaagucgaggaaccuggcggacgacauggugagaaauucagcgcgagaccuuuuuuaccaugccguuacccacgaugccguccuugucuuugaaaaccugagcagggguuuuggaaggcagggcaaaaggaccuucaugacggaaagacaauauacaaagauggaagacuggcugacagcgaagcucgcauacgaaggucuuacgucaaaaaccuaccuuucaaagacgcuggcgcaauauacgucaaaaacaugcuccaacugcggguuuacuauaacgacugccgauuaugacgggauguugguaaggcuuaaaaagacuucugauggaugggcaacuacccucaacaacaaagaauuaaaagccgaaggccagauaacguauuauaaccgguauaaaaggcaaaccguggaaaaagaacucuccgcagagcuugacaggcuuucagaagagucgggcaauaaugauauuucuaaguggaccaagggucgccgggacgaggcauuauuuuuguuaaagaaaagauucagccaucggccuguucaggaacaguuuguuugccucgauugcggccaugaaguccacgccgaugaacaggcagccuugaauauugcaaggucauggcuuuuucuaaacucaaauucaacagaauucaaaaguuauaaaucggguaaacagcccuucguuggugcuuggcaggccuuuuacaaaaggaggcuuaaagagguauggaagcccaacgccuga

SEQ ID NO: 11121 - RNA, 2961 nt, Artificial Sequence
  CasX variant__Deltaproteobacteria bacterium__OGP07438.1__CasX
auggagaagcguauuaacaagauucguaagaaguuaucggcugauaaugccacaaaaccuguaagccgcucaggaccuaugaaaacgcuuuuaguucguguuaugacagaugaucugaaaaaacgucuugagaagcgucguaaaaagccggaggucaugccucaagucauuucgaauaaugccgccaauaauuuacguaugcuucuugaugacuauacaaagaugaaagaagcaauccugcaagucuacuggcaagaguucaaagaugaucauguagguuugauguguaaguuugcacagcccgcuaguaaaaagaucgaccaaaacaaguuaaagccagagauggacgagaaagggaaucuuaccacugccggguucgcuugcucucaaugcggccaaccgcuguucguauauaagcuggagcaaguuucagaaaaggguaaggcauacacaaauuauuucggacguugcaacgucgcugagcacgagaagcuuauucuuuuagcccagcugaaaccagagaaggacucugaugaagcgguuaccuacuccuugggaaaguucggacagcgcgcucuugacuuuuauuccauccacgugacaaaggaaaguacacaccccgucaaaccacuggcccaaauugcagggaaccgcuacgcgagcgggccagugggaaaagcauugucagacgcuuguaugggcacgauugcuuccuuucuuaguaaauaccaggauauuaucauugaacaucaaaagguaguuaaggggaaccagaagcgucuggaaagcuuacgugaacuugcagggaaagagaaccuugaguacccaucggucacauugccuccgcagccgcacacaaaggagggugucgaugcuuauaacgaggugauugcacgcguacgcauguggguaaauuugaaucuguggcagaaguugaaacugucgcgugaugacgccaaaccucuuuuacgccugaagggcuuccccucauuuccagucguagagcgccgugaaaaugaaguagacugguggaauacuaucaacgaaguaaaaaagcugauugacgcgaagcgcgacaugggacgcguguuuuggagcggcguuacugcugaaaagcgcaacaccauccuugaaggauacaacuauuuacccaacgagaacgaucauaaaaagcgcgagggcaguuuagagaauccgaagaagccggccaaacgucaguuuggcgaccuuuuauuauaccuggaaaagaaauaugcgggugacuggggcaaaguguucgaugaagccugggagcgcauugacaagaaaaucgcuggucugacgucgcacauugagcgcgaggaagcucguaacgcagaagacgcccaauccaaagcgguccugacagacuggcugcgcgcuaaggcguccuuuguucuugagcguuuaaaagagauggacgaaaaggaauucuaugccugugagauucaauuacaaaagugguauggugacuuacgcgggaaccccuuugcuguagaggcugagaaucguguaguggacauuucagguuucagcaucggaucggauggacauucuauccaauaucguaaccuucuugcauggaaauauuuggagaaugguaagcgcgaguucuaucugcuuaugaacuacgggaaaaaaggacguauucgcuucaccgaugguacagacauuaaaaaaaguggcaaauggcaaggguuguuauauggggguggcaaagcaaagguuaucgauuuaacguuugaucccgaugaugagcagcugauuaucuugccuuuagcuuucggaacccgccagggccgugaauuuaucuggaacgacuugcuuucucuugagacaggacuuaucaaacuugcgaauggacgcgugaucgaaaagacuauuuacaauaaaaagaucggucgcgaugagccggcccuguuugucgccuuaacauucgagcgucgcgaaguuguugauccgucaaauaucaagccgguaaacuuaaucggggucgaucguggugaaaauaucccggcaguaaucgcucuuacagacccagaaggcugccccuuacccgaguucaaggacucauccggcgguccaacagacauccuucgcauuggcgaaggauauaaagagaaacagcgugcaauccaggcagcaaaagaaguggaacaacgucgcgccggaggcuacagccgcaaauuugcgucaaaaucgcguaacuuggcagaugauaugguccgcaacagcgcccgugauuuguuuuaccacgcggugacacaugacgcuguuuuaguuuuugagaacuugucacguggguucggacgucagggaaaacgcaccuucaugacugagcgccaauacacaaaaauggaagacugguugacggcuaaacuggcuuacgaggggcuuacuaguaaaacguauuugucgaaaacucuugcucaguacaccucuaaaacuuguucuaacugcggguucacgauuaccacagcggacuacgauggcaugcugguacgccuuaaaaagacgagcgacgggugggcaacgacauugaacaauaaagaacuuaaggccgagggacaaaucaccuacuauaaucguuauaagcgccagacgguagaaaaagaguuaagcgccgaacuugaccgccugagcgaggagagugggaacaacgacauuucaaaauggacuaaggggcgccgugacgaggcuuuguuuuugcugaagaaacguuucucccaucgucccguacaagagcaguucguuugcuuagauuguggccaugaaguucaugcugaugaacaggcugcuuuaaauaucgcgcguuccugguuguuucuuaauaguaacucaacugaguucaaaucauauaagucagggaaacagccguuugugggagcauggcaggcuuuuuauaaacgccgccugaaggaggucuggaagccgaaugcuuga

SEQ ID NO: 11122 - RNA, 2937 nt, Artificial Sequence
  CasX variant__Planctomycetes bacterium__OHB99618.1__CasX
augcaggaaauaaaaaggauaaauaaaauacgaaggagauugguaaaggauagcaacacgaaaaaagccggcaaaaccggcccuaugaaaaccuugcucguucggguuaugacaccugaccugagagaaagguuagagaaucuucgcaaaaagccggaaaacauuccucagcccauuucaaauacuucacgugcaaauuuaaauaaacuccucacugacuauacggaaaugaagaaagcaauccugcauguuuauugggaagaguuccaaaaagacccugucggauugaugagcaggguugcacaaccagcgcccaagaauauugaucagagaaaauugauuccggugaaggacggaaaugagagacuaacaaguucuggauuugccuguucucagugcugucaaccccucuauguuuauaagcuugaacaagugaaugacaaggguaagccccauacaaauuacuuuggccguuguaaugucuccgagcaugaacguuugauauugcucucgccgcauaaaccggaggcaaaugacgagcuaguaacguauucguuggggaaguucggucaaagggcauuggacuuuuauucaauccacguaacaagagaaucgaaccauccuguaaagccgcuagaacagaucgguggcaauagcugcgcaaguggucccguugguaaggcuuuaucugaugccuguaugggagcaguagccaguuuccuuacaaaguaccaggacaucauccucgaacaccaaaagguuauaaaaaaaaacgaaaagagauuggcaaaucuaaaggauauagcaagugcaaacgggcuugcauuuccuaaaaucacucuuccaccgcaaccgcauacaaaagaagggauugaagcuuauaacaauguuguugcucagauagugaucuggguaaaccugaaucuuuggcagaaacucaaaauuggcagggaugaggcaaagcccuuacagcggcuuaaggguuuuccguccuucccucuuguugaacgccaggcgaaugagguugauuggugggauauggucuguaaugucaaaaaguugauuaacgaaaagaaagaggacgggaaggucuucuggcaaaaucuugcuggauauaaaaggcaggaagccuugcuuccauaucuuucgucugaagaagaccguaaaaaaggaaaaaaguuugcgcguuaucaguuuggugaccuuuugcuucaccuugaaaagaaacacggugaagauuggggcaaaguuuaugaugaggcaugggaaagaauagauaaaaaaguugaaggucugaguaagcacauaaaguuggaggaagaaagaaggucugaagaugcucaaucaaaggcugcccucacugauuggcucagggcaaaggccucuuuuguuauugaagggcucaaagaagcugauaaggaugaguuuugcaggugugaguuaaagcuucaaaagugguauggagauuugagaggaaaaccauuugcuauagaagcagagaacagcauuuuagauauaagcggauuuucuaaacaguauaauugugcauuuauauggcagaaagacggcguaaagaaguuaaaucuuuauuuaauaauaaauuacuucaaaggugguaagcuacgcuucaaaaaaaucaagccagaagcuuuugaagcaaauagguuuuauacaguaauuaauaaaaaaagcggugagauugugccuauggaggucaacuucaauuuugaugacccgaauuugauaauucugccuuuggccuuuggaaaaaggcaggggagggaguuuaucuggaacgaccuauugagccuugagacggguucauugaaacucgccaauggcaggguuauugaaaaaacgcucuauaacagaaggacgagacaggaugaaccagcacuuuuuguugcccugacauuugaaagaagagaggugcuugacucaucgaauauaaaaccgaugaaucugauaggaauagaccggggagaaaauaucccggcagucauagcauuaacagacccggaaggaugccccuugucaagauucaaagauucauugggcaauccaacgcauauuuugcgaauaggagaaaguuauaaggaaaaacaacggacuauucaggcugcuaaagaaguugaacaaaggcgggcaggcggauauucgagaaaauaugcaucaaaggcgaagaaucuggcggacgauaugguaagaaauacagcucgugaccucuuauauuaugcuguuacucaagaugcaaugcucauuuuugaaaaucuuucccgcgguuuugguagacaaggcaagaggacuuuuauggcggaaaggcaguacacgaggauggaagacuggcugacugcaaagcuugccuaugaaggucugccaucaaaaaccuaucuuucaaagacucuggcacaguauaccucaaagacauguucuaauugugguuuuacaaucacaagugcagauuaugacagggugcucgaaaagcucaagaagacggcuacuggauggaugacuacaaucaauggaaaagaguuaaaaguugaaggacagauaacauacuauaaccgguauaaaaggcagaaugugguaaaagaccucucuguagagcuggauagacuuucggaagagucgguaaauaaugauauuucuaguuggacaaaaggccgcaguggugaagcuuuaucucugcuaaaaaagagauuuagucacaggccggugcaggaaaaguuuguuugccugaacugugguuuugaaacccaugcagacgaacaagcagcacugaauauugcaaggucguggcucuuucuccguucucaagaauauaagaaguaucaaaccaauaaaacgaccggaaauacugacaaaagggcauuuguugaaacauggcaauccuuuuacagaaagaagcucaaagaaguauggaaaccagccgucuga

SEQ ID NO: 11123 - RNA, 3378 nt, Artificial Sequence
  CasY variant__Candidatus Katanobacteria bacterium__OJI08769.1__CasY
augcgcaaaaaauuguuuaaggguuacauuuuacauaauaagaggcuuguauauacagguaaagcugcaauacguucuauuaaauauccauuagucgcuccaaauaaaacagccuuaaacaauuuaucagaaaagauaauuuaugauuaugagcauuuauucggaccuuuaaauguggcuagcuaugcaagaaauucaaacagguacagccuuguggauuuuuggauagauagcuugcgagcagguguaauuuggcaaagcaaaaguacuucgcuaauugauuugauaaguaagcuagaaggaucuaaauccccaucagaaaagauauuugaacaaauagauuuugagcuaaaaaauaaguuggauaaagagcaauucaaagauauuauucuucuuaauacaggaauucguucuagcaguaauguucgcaguuugagggggcgcuuucuaaaguguuuuaaagaggaauuuagagauaccgaagagguuaucgccuguguagauaaauggagcaaggaccuuaucguagaggguaaaaguauacuagugaguaaacaguuucuuuauugggaagaagaguuugguauuaaaauuuuuccucauuuuaaagauaaucacgauuuaccaaaacuaacuuuuuuuguggagccuuccuuggaauuuaguccgcaccucccuuuagccaacugucuugagcguuugaaaaaauucgauauuucgcgugaaaguuugcucggguuagacaauaauuuuucggccuuuucuaauuauuucaaugagcuuuuuaacuuauuguccaggggggagauuaaaaagauuguaacagcuguccuugcuguuucuaaaucgugggagaaugagccagaauuggaaaagcgcuuacauuuuuugagugagaaggcaaaguuauuaggguacccuaagcuuacuucuucgugggcggauuauagaaugauuauuggcggaaaaauuaaaucuuggcauucuaacuauaccgaacaauuaauaaaaguuagagaggacuuaaagaaacaucaaaucgcccuugauaaauuacaggaagauuuaaaaaaaguaguagauagcucuuuaagagaacaaauagaagcucaacgagaagcuuugcuuccuuugcuugauaccauguuaaaagaaaaagauuuuuccgaugauuuagagcuuuacagauuuaucuugucagauuuuaagaguuuguuaaaugggucuuaucaaagauauauucaaacagaagaggagagaaaggaggacagagauguuaccaaaaaauauaaagauuuauauaguaauuugcgcaacauaccuagauuuuuuggggaaaguaaaaaggaacaauucaauaaauuuauaaauaaaucucucccgaccauagauguugguuuaaaaauacuugaggauauucguaaugcucuagaaacuguaaguguucgcaaacccccuucaauaacagaagaguauguaacaaagcaacuugagaaguuaaguagaaaguacaaaauuaacgccuuuaauucaaacagauuuaaacaaauaacugaacaggugcucagaaaauauaauaacggagaacuaccaaagaucucggagguuuuuuauagauacccgagagaaucucauguggcuauaagaauauuaccuguuaaaauaagcaauccaagaaaggauauaucuuaucuucucgacaaauaucaaauuagccccgacuggaaaaacaguaacccaggagaaguuguagauuugauagagauauauaaauugacauuggguuggcucuugaguuguaacaaggauuuuucgauggauuuuucaucguaugacuugaaacucuucccagaagccgcuucccucauaaaaaauuuuggcucuugcuugagugguuacuauuuaagcaaaaugauauuuaauugcauaaccagugaaauaaaggggaugauuacuuuauauacuagagacaaguuuguuguuagauauguuacacaaaugauagguagcaaucagaaauuuccuuuguuauguuuggugggagagaaacagacuaaaaacuuuucucgcaacugggguguauugauagaagagaagggagauuugggggaggaaaaaaaccaggaaaaauguuugauauuuaaggauaaaacagauuuugcuaaagcuaaagaaguagaaauuuuuaaaaauaauauuuggcguaucagaaccucuaaguaccaaauccaauuuuugaauaggcuuuuuaagaaaaccaaagaaugggauuuaaugaaucuuguauugagcgagccuagcuuaguauuggaggaggaaugggguguuucgugggauaaagauaaacuuuuaccuuuacugaagaaagaaaaaucuugcgaagaaagauuauauuacucacuuccccuuaacuuggugccugccacagauuauaaggagcaaucugcagaaauagagcaaaggaauacauauuuggguuuggauguuggagaauuugguguugccuaugcagugguaagaauaguaagggacagaauagagcuucuguccuggggauuccuuaaggacccagcucuucgaaaaauaagagagcguguacaggauaugaagaaaaagcagguaauggcaguauuuucuagcucuuccacagcugucgcgcgaguacgagaaauggcuauacacucuuuaagaaaucaaauucauagcauugcuuuggcguauaaagcaaagauaauuuaugagauaucuauaagcaauuuugagacaggugguaauagaauggcuaaaauauaccgaucuauaaagguuucagauguuuauagggagaguggugcggauacccuaguuucagagaugaucuggggcaaaaagaauaagcaaaugggaaaccauauaucuuccuaugcgacaaguuacacuuguugcaauugugcaagaaccccuuuugaacuuguuauagauaaugacaaggaauaugaaaagggaggcgacgaauuuauuuuuaauguuggcgaugaaaagaagguaaggggguuuuuacaaaagagucuguuaggaaaaacaauuaaagggaaggaaguguugaagucuauaaaagaguacgcaaggccgccuauaagggaagucuugcuugaaggagaagauguagagcaguuguugaagaggagaggaaauagcuauauuuauagaugcccuuuuuguggauauaaaacugaugcggauauucaagcggcguugaauauagcuuguaggggauauauuucggauaacgcaaaggaugcugugaaggaaggagaaagaaaauuagauuacauuuuggaaguuagaaaauugugggagaagaauggagcuguuuugagaagcgccaaauuuuuauag

SEQ ID NO: 11124 - RNA, 3378 nt, Artificial Sequence
  CasY variant__Candidatus Katanobacteria bacterium__OJI08769.1__CasY
augcguaagaagcuguucaaaggcuacauccugcacaacaagcguuugguuuacacagggaaagcggcuauccgcucgauuaaguauccccuggucgccccaaauaagaccgcguuaaauaacuugagugagaaaauuauuuaugauuacgagcacuuauuugguccucugaacgucgcgucguaugcgcguaauucaaaucguuacuccuuaguugauuuuuggauugacucuuuacgugcuggcgucauuuggcagucgaaaagcacuagucugauugauuuaauuaguaaguuagagggaucaaagucaccuucagagaaaaucuuugagcagaucgacuuugaauugaagaauaagcuggacaaggaacaguuuaaggacaucauucuucugaacacaggcauucgcagcuccucuaacgugcgcagccuucgcggccguuuucugaaguguuucaaggaagaauuccgugacaccgaagagguuauugcguguguagauaagugguccaaggaccugauuguggaagggaaaucgauuuuaguuucuaagcaguuuuuguauugggaggaggaauucgguaucaagaucuucccucauuuuaaagauaaccaugaucuuccaaaauugacauucuucguagaaccuagucuugaguuuagcccacaucugccguuagcuaauuguuuagaacguuugaagaaguuugauaucagucgugaaucccuguuggggcuggacaacaacuuuucggcguucagcaacuauuucaacgagcuuuuuaaccugcuuucgcguggggagaucaaaaaaaucgugaccgcuguguuggcugugagcaagucuugggaaaacgaacccgaguuagaaaaacguuugcacuucuuaucugaaaaagcgaaauugcugggcuacccuaagcuuaccagcucuugggcggacuaucguaugaucaucggagggaaaauuaagaguuggcauucaaacuauacggagcaacugauuaaaguccgugaggacuugaagaaacaucaaaucgcuuuggacaagcugcaggaagaccugaagaaagucguugauucuucauugcgugagcagauugaggcucaacgugaggcgcugcugccgcugcuggacaccaugcuuaaggaaaaagauuuuuccgaugaucuugaauuauaucguuuuauuuugagugauuuuaagucccuucugaacggguccuaccagcgcuacauccagacugaagaggaacgcaaagaggaucgugauguaacuaaaaaguauaaggacuuguacucaaaucuucguaauauuccccguuucuuuggcgagagcaagaaagagcaauucaacaaauuuaucaauaagagucuuccuaccauugacgucggucuuaaaauuuuggaggauauccguaacgcacuggagacaguuuccgugcgcaagccuccgucaauuacggaggaguauguuacaaaacaauuagagaaguugucccguaaauauaaaaucaaugcauucaauaguaaccguuuuaaacagaucaccgaacagguauugcgcaaguacaauaauggcgaguugccuaaaauuucggaaguguucuaccguuacccacgugaaucucaugucgccauucguauucugccggucaaaaucucgaauccccguaaggacaucagcuauuuauuagauaaguaccaaauuuccccugauuggaagaacucaaacccgggugagguuguugaucugauugagauuuauaagcugacccugggcuggcuucugucauguaauaaggauuucucuauggacuuuucaagcuaugauuuaaaguuauucccugaggcugcguccuuaauuaagaacuuugggagcugccuuuccgguuacuacuugaguaagaugaucuuuaacugcauuaccagcgaaaucaaggggaugaucacgcuguauacucgcgauaaauucguuguucguuacguuacccaaaugauuggcucuaaccaaaaguucccccuucuuugcuuggugggagaaaaacagacgaagaacuucucgcgcaacuggggggugcuuaucgaagagaaaggugaccugggugaagaaaagaaccaggagaagugccugaucuucaaggauaaaacugauuuugcaaaggcgaaggaaguggaaaucuucaaaaauaacauuuggcgcauucguaccucgaaguaucaaauccaguuuuuaaaccgcuuauucaaaaagacaaaggagugggacuugaugaacuugguauuaucagaaccgucuuuaguuuuagaagaagaguggggcguuuccugggacaaggacaaguuauuaccgcuucugaagaaggaaaaaucgugcgaagaacgcuuguacuauucuuugccgcuuaaucuggucccggcaacggauuauaaagagcaaucagcagaaaucgaacagcgcaacacuuaucugggccuggaugugggggaauuugggguggccuaugcgguuguucgcaucguucgcgaccgcauugaauuauugaguuggggauuuuugaaggauccugcauugcguaagauccgugagcguguacaggacaugaaaaagaaacaagugauggcaguguuuucgucuuccuccacugcaguagcccgcguucgcgagauggcaauccauucucugcguaaucaaauucauaguaucgcacuggcuuauaaagcuaagauuauuuaugagauuucuauuuccaauuuugaaaccgguggaaaccguauggcgaaaauuuaccgcaguauuaagguuucggaugucuaccgcgaaucgggagcagacacgcuuguuagcgaaaugaucuggggaaagaaaaauaagcagauggggaaucacauuuccucuuaugcgacuaguuauacguguugcaauugugcucgcacgccauuugaguuaguuaucgauaacgauaaggaauaugaaaaaggcggugaugaguuuaucuucaacgucggagaugaaaagaaagugcguggcuuucuucagaagagccuguugggcaaaacuauuaaggguaaggaaguccuuaagaguauuaaagaauaugcccgccccccgauccgcgaaguuuuauuagagggggaagauguagaacaguuguugaaacgccgugguaacagcuauauuuaccguugcccauuuuguggauacaaaacggaugcugacauccaggcggcgcuuaauauugcaugccgugguuacauuagcgauaaugcuaaggaugcaguaaaggagggggagcgcaaauuggauuacauccuggagguccguaaguuaugggaaaagaacggggccgugcugcguucugcaaaguuccuguga

SEQ ID NO: 11125 - RNA, 3864 nt, Artificial Sequence
  CasY variant__Candidatus Kerfeldbacteria bacterium__OGY82221.1__CasY
augaagagaauucugaacagucugaaaguugcugccuugagacuucuguuucgaggcaaagguucugaauuagugaagacagucaaauauccauugguuuccccgguucaaggcgcgguugaagaacuugcugaagcaauucggcacgacaaccugcaccuuuuugggcagaaggaaauaguggaucuuauggagaaagacgaaggaacccagguguauucgguuguggauuuuugguuggauacccugcguuuagggauguuuuucucaccaucagcgaaugcguugaaaaucacgcugggaaaauucaauucugaucagguuucaccuuuucguaagguuuuggagcagucaccuuuuuuucuugcgggucgcuugaagguugaaccugcggaaaggauacuuucuguugaaaucagaaagauugguaaaagagaaaacagaguugagaacuaugccgccgauguggagacaugcuucauuggucagcuuucuucagaugagaaacagaguauccagaagcuggcaaaugauaucugggauagcaaggaucaugaggaacagagaauguugaaggcggauuuuuuugcuauaccucuuauaaaagaccccaaagcugucacagaagaagauccugaaaaugaaacggcgggaaaacagaaaccgcuugaauuauguguuugucuuguuccugaguuguauacccgagguuucggcuccauugcugauuuucugguucagcgacuuaccuugcugcgugacaaaaugaguaccgacacggcggaagauugccucgaguauguuggcauugaggaagaaaaaggcaauggaaugaauuccuugcucggcacuuuuuugaagaaccugcagggugaugguuuugaacagauuuuucaguuuaugcuugggucuuauguuggcuggcaggggaaggaagauguacugcgcgaacgauuggauuugcuggccgaaaaagucaaaagauuaccaaagccaaaauuugccggagaauggaguggucaucguauguuucuccauggucagcugaaaagcuggucgucgaauuucuuccgucuuuuuaaugagacgcgggaacuucuggaaaguaucaagagugauauucaacaugccaccaugcucauuagcuauguggaagagaaaggaggcuaucauccacagcuguugagucaguaucggaaguuaauggaacaauuaccggcguugcggacuaagguuuuggauccugagauugagaugacgcauauguccgaggcuguucgaaguuacauuaugauacacaagucuguagcgggauuucugccggauuuacucgagucuuuggaucgagauaaggauagggaauuuuugcuuuccaucuuuccucguauuccaaagauagauaagaagacgaaagagaucguugcaugggagcuaccgggcgagccagaggaaggcuauuuguucacagcaaacaaccuuuuccggaauuuucuugagaauccgaaacaugugccacgauuuauggcagagaggauucccgaggauuggacgcguuugcgcucggccccugugugguuugaugggauggugaagcaauggcagaagguggugaaucaguugguugaaucuccaggcgcccuuuaucaguucaaugaaaguuuuuugcgucaaagacugcaagcaaugcuuacggucuauaagcgggaucuccagacugagaaguuucugaagcugcuggcugaugucugucguccacucguugauuuuuucggacuuggaggaaaugauauuaucuucaagucaugucaggauccaagaaagcaauggcagacuguuauuccacucagugucccagcggauguuuauacagcaugugaaggcuuggcuauucgucuccgcgaaacucuuggauucgaauggaaaaaucugaaaggacacgagcgggaagauuuuuuacggcugcaucaguugcugggaaaucugcuguucuggaucagggaugcgaaacuugucgugaagcuggaagacuggaugaacaauccuuguguucaggaguauguggaagcacgaaaagccauugaucuucccuuggagauuuucggauuugaggugccgauuuuucucaauggcuaucucuuuucggaacugcgccagcuggaauuguugcugaggcguaagucggugaugacgucuuacagcgucaaaacgacaggcucgccaaauaggcucuuccaguugguuuaccuaccucuaaacccuucagauccggaaaagaaaaauuccaacaacuuucaggagcgccucgauacaccuaccgguuugucgcgucguuuucuggaucuuacgcuggaugcauuugcuggcaaacucuugacggauccgguaacucaggaacugaagacgauggccgguuuuuacgaucaucucuuuggcuucaaguugccguguaaacuggcggcgaugaguaaccauccaggauccucuuccaaaauggugguucuggcaaaaccaaagaaggguguugcuaguaacaucggcuuugaaccuauucccgauccugcucauccuguguuccgggugagaaguuccuggccggaguugaaguaccuggagggguuguuguaucuucccgaagauacaccacugaccauugaacuggcggaaacgucggucaguugucagucugugaguucagucgcuuucgauuugaagaaucugacgacuaucuugggucguguuggugaauucagggugacggcagaucaaccuuucaagcugacgcccauuauuccugagaaagaggaauccuucaucgggaagaccuaccucggucuugaugcuggagagcgaucuggcguugguuucgcgauugugacgguugacggcgauggguaugaggugcagagguugggugugcaugaagauacucagcuuauggcgcuucagcaagucgccagcaagucucuuaaggagccgguuuuccagccacuccguaagggcacauuucgucagcaggagcgcauucgcaaaagccuccgcgguugcuacuggaauuucuaucaugcauugaugaucaaguaccgagcuaaaguugugcaugaggaaucgguggguucauccggucugguggggcaguggcugcgugcauuucagaaggaucucaaaaaggcugauguucugcccaagaaggguggaaaaaaugguguagacaaaaaaaagagagaaagcagcgcucaggauaccuuauggggaggagcuuucucgaagaaggaagagcagcagauagccuuugagguucaggcagcuggaucaagccaguuuugucugaagugugguuggugguuucaguuggggaugcgggaaguaaaucgugugcaggagaguggcguggugcuggacuggaaccgguccauuguaaccuuccucaucgaauccucaggagaaaagguauaugguuucaguccucagcaacuggaaaaaggcuuucguccugacaucgaaacguucaaaaaaaugguaagggauuuuaugagaccccccauguuugaucgcaaaggucggccggccgcggcguaugaaagauucguacugggacgucgucaccgucguuaucgcuuugauaaaguuuuugaagagagauuuggucgcagugcucuuuucaucugcccgcgggucgggugugggaauuucgaucacuccagugagcagucagccguuguccuugcccuuauugguuacauugcugauaaggaagggaugagugguaagaagcuuguuuaugugaggcuggcugaacuuauggcugaguggaagcugaagaaacuggagagaucaaggguggaagaacagagcucggcacaauaa

SEQ ID NO: 11126 - RNA, 3579 nt, Artificial Sequence
  CasY variant__Candidatus Komeilibacteria bacterium__OJI06454.1__CasY
auggcagaaagcaagcagaugcaaugccgcaagugcggcgcaagcaugaaguaugaaguaauuggauugggcaagaagucaugcagauauaugugcccagauugcggcaaucacaccagcgcgcgcaagauucagaacaagaaaaagcgcgacaaaaaguauggauccgcaagcaaagcgcagagccagaggauagcuguggcuggcgcgcuuuauccagacaaaaaagugcagaccauaaagaccuacaaauacccagcggaucugaauggcgaaguucaugacagaggcgucgcagagaagauugagcaggcgauucaggaagaugagaucggccugcuuggcccguccagcgaauacgcuugcuggauugcuucacaaaaacaaagcgagccguauucaguuguagauuuuugguuugacgcggugugcgcaggcggaguauucgcguauucuggcgcgcgccugcuuuccacaguccuccaguugaguggcgaggaaagcguuuugcgcgcugcuuuagcaucuagcccguuuguagaugacauuaauuuggcgcaagcggaaaaguuccuagccguuagccggcgcacaggccaagauaagcuaggcaagcgcauuggagaauguuucgcggaaggccggcuugaagcgcuuggcaucaaagaucgcaugcgcgaauucgugcaagcgauugauguggcccaaaccgcgggccagcgguucgcggccaagcuaaagauauucggcaucagucagaugccugaagccaagcaauggaacaaugauuccgggcucacuguauguauuuugccggauuauuaugucccggaagaaaaccgcgcggaccagcugguuguuuugcuucggcgcuuacgcgagaucgcguauugcaugggaauugaggaugaagcaggauuugagcaucuaggcauugacccuggcgcucuuuccaauuuuuccaauggcaauccaaagcgaggauuucucggccgccugcucaauaaugacauuauagcgcuggcaaacaacaugucagccaugacgccguauugggaaggcagaaaaggcgaguugauugagcgccuugcauggcuuaaacaucgcgcugaaggauuguauuugaaagagccacauuucggcaacuccugggcagaccaccgcagcaggauuuucagucgcauugcgggcuggcuuuccggaugcgcgggcaagcucaagauugccaaggaucagauuucaggcgugcguacggauuuguuucugcucaagcgccuucuggaugcgguaccgcaaagcgcgccgucgccggacuuuauugcuuccaucagcgcgcuggaucgguuuuuggaagcggcagaaagcagccaggauccggcagaacagguacgcgcuuuguacgcguuucaucugaacgcgccugcgguccgauccaucgccaacaaggcgguacagaggucugauucccaggaguggcuuaucaaggaacuggaugcuguagaucaccuugaauucaacaaagcauuuccguuuuuuucggauacaggaaagaaaaagaagaaaggagcgaauagcaacggagcgccuucugaagaagaauacacggaaacagaauccauucaacaaccagaagaugcagagcaggaagugaauggucaagaaggaaauggcgcuucaaagaaccagaaaaaguuucagcgcauuccucgauuuuucggggaagggucaaggagugaguaucgaauuuuaacagaagcgccgcaauauuuugacauguucugcaauaauaugcgcgcgaucuuuaugcagcuagagagucagccgcgcaaggcgccucgugauuucaaaugcuuucugcagaaucguuugcagaagcuuuacaagcaaaccuuucucaaugcucgcaguaauaaaugccgcgcgcuucuggaauccguccuuauuucauggggagaauuuuauacuuauggcgcgaaugaaaagaaguuucgucugcgccaugaagcgagcgagcgcagcucggauccggacuaugugguucagcaggcauuggaaaucgcgcgccggcuuuucuuguucggauuugaguggcgcgauugcucugcuggagagcgcguggauuugguugaaauccacaaaaaagcaaucucauuuuugcuugcaaucacucaggccgagguuucaguugguuccuauaacuggcuugggaauagcaccgugagccgguaucuuucgguugcuggcacagacacauuguacggcacucaacuggaggaguuuuugaacgccacagugcuuucacagaugcgugggcuggcgauucggcuuucaucucaggaguuaaaagacggauuugauguucaguuggagaguucgugccaggacaaucuccagcaucugcugguguaucgcgcuucgcgcgacuuggcugcgugcaaacgcgcuacaugcccggcugaauuggauccgaaaauucuuguucugccggcuggugcguuuaucgcgagcguaaugaaaaugauugagcguggcgaugaaccauuagcaggcgcguauuugcgucaucggccgcauucauucggcuggcagauacggguucguggaguggcggaaguaggcauggaucagggcacagcgcuagcauuccagaagccgacugaaucagagccguuuaaaauaaagccguuuuccgcucaauacggcccaguacuuuggcuuaauucuucauccuauagccagagccaguaucuggauggauuuuuaagccagccaaagaauuggucuaugcgggugcuaccucaagccggaucagugcgcguggaacagcgcguugcucugauauggaauuugcaggcaggcaagaugcggcuggagcgcucuggagcgcgcgcguuuuucaugccagugccauucagcuucaggccgucugguucaggagaugaagcaguauuggcgccgaaucgguacuugggacuuuuuccgcauuccggaggaauagaauacgcggugguggauguauuagauuccgcggguuucaaaauucuugagcgcgguacgauugcgguaaauggcuuuucccagaagcgcggcgaacgccaagaggaggcacacagagaaaaacagagacgcggaauuucugauauaggccgcaagaagccggugcaagcugaaguugacgcagccaaugaauugcaccgcaaauacaccgauguugccacucguuuagggugcagaauugugguucagugggcgccccagccaaagccgggcacagcgccgaccgcgcaaacaguauacgcgcgcgcagugcggaccgaagcgccgcgaucuggaaaucaagaggaucaugcucguaugaaauccucuuggggauauaccuggagcaccuauugggagaagcgcaaaccagaggauauuuugggcaucucaacccaaguauacuggaccggcgguauaggcgagucaugucccgcagucgcgguugcgcuuuuggggcacauuagggcaacauccacucaaacugaaugggaaaaagaggagguuguauucggucgacugaagaaguucuuuccaagcuag

SEQ ID NO: 11127 - RNA, 3633 nt, Artificial Sequence
  CasY variant__Candidatus Parcubacteria bacterium__APG80656.1__CasY
augaguaagcgacauccuagaauuagcggcguaaaaggguaccguuugcaugcgcaacggcuggaauauaccggcaaaaguggggcaaugcgaacgauuaaauauccucuuuauucaucuccgagcgguggaagaacgguuccgcgcgagauaguuucagcaaucaaugaugauuauguagggcuguacgguuugaguaauuuugacgaucuguauaaugcggaaaagcgcaacgaagaaaaggucuacucgguuuuagauuuuugguacgacugcguccaauacggcgcgguuuuuucguauacagcgccgggucuuuugaaaaauguugccgaaguucgcgggggaagcuacgaacuuacaaaaacgcuuaaagggagccauuuauaugaugaauugcaaauugauaaaguaauuaaauuuuugaauaaaaaagaaauuucgcgagcaaacggaucgcuugauaaacugaagaaagacaucauugauugcuucaaagcagaauaucgggaacgacauaaagaucaaugcaauaaacuggcugaugauauuaaaaaugcaaaaaaagacgcgggagcuucuuuaggggagcgucaaaaaaaauuauuucgcgauuuuuuuggaauuucagagcagucugaaaaugauaaaccgucuuuuacuaauccgcuaaacuuaaccugcuguuuauugccuuuugacacagugaauaacaacagaaaccgcggcgaaguuuuguuuaacaagcucaaggaauaugcucaaaaauuggauaaaaacgaagggucgcuugaaaugugggaauauauuggcaucgggaacagcggcacugccuuuucuaauuuuuuaggagaaggguuuuugggcagauugcgcgagaauaaaauuacagagcugaaaaaagccaugauggauauuacagaugcauggcgugggcaggaacaggaagaagaguuagaaaaacgucugcggauacuugccgcgcuuaccauaaaauugcgcgagccgaaauuugacaaccacuggggaggguaucgcagugauauaaacggcaaauuaucuagcuggcuucagaauuacauaaaucaaacagucaaaaucaaagaggacuuaaagggacacaaaaaggaccugaaaaaagcgaaagagaugauaaauagguuuggggaaagcgacacaaaggaagaggcgguuguuucaucuuugcuugaaagcauugaaaaaauuguuccugaugauagcgcugaugacgagaaacccgauauuccagcuauugcuaucuaucgccgcuuucuuucggauggacgauuaacauugaaucgcuuuguccaaagagaagaugugcaagaggcgcugauaaaagaaagauuggaagcggagaaaaagaaaaaaccgaaaaagcgaaaaaagaaaagugacgcugaagaugaaaaagaaacaauugacuucaaggaguuauuuccucaucuugccaaaccauuaaaauuggugccaaacuuuuacggcgacaguaagcgugagcuguacaagaaauauaagaacgccgcuauuuauacagaugcucuguggaaagcaguggaaaaaauauacaaaagcgcguucucgucgucucuaaaaaauucauuuuuugauacagauuuugauaaagauuuuuuuauuaagcggcuucagaaaauuuuuucgguuuaucgucgguuuaauacagacaaauggaaaccgauugugaaaaacucuuucgcgcccuauugcgacaucgucucacuugcggagaaugaaguuuuguauaaaccgaaacagucgcgcaguagaaaaucugccgcgauugauaaaaacagagugcgucucccuuccacugaaaauaucgcaaaagcuggcauugcccucgcgcgggagcuuucagucgcaggauuugacuggaaagauuuguuaaaaaaagaggagcaugaagaauacauugaucucauagaauugcacaaaaccgcgcuugcgcuucuucuugccguaacagaaacacagcuugacauaagcgcguuggauuuuguagaaaaugggacggucaaggauuuuaugaaaacgcgggacggcaaucugguuuuggaagggcguuuccuugaaauguucucgcagucaauuguguuuucagaauugcgcgggcuugcggguuuaaugagccgcaaggaauuuaucacucgcuccgcgauucaaacuaugaacggcaaacaggcggagcuucucuacauuccgcaugaauuccaaucggcaaaaauuacaacgccaaaggaaaugagcagggcguuucuugaccuugcgcccgcggaauuugcuacaucgcuugagccagaaucgcuuucggagaagucauuauugaaauugaagcagaugcgguacuauccgcauuauuuuggauaugagcuuacgcgaacaggacaggggauugaugguggagucgcggaaaaugcguuacgacuugagaagucgccaguaaaaaaacgagagauaaaaugcaaacaguauaaaacuuugggacgcggacaaaauaaaauaguguuauauguccgcaguucuuauuaucagacgcaauuuuuggaaugguuuuugcaucggccgaaaaacguucaaaccgauguugcgguuagcgguucguuucuuaucgacgaaaagaaaguaaaaacucgcuggaauuaugacgcgcuuacagucgcgcuugaaccaguuuccggaagcgagcgggucuuugucucacagccguuuacuauuuuuccggaaaaaagcgcagaggaagaaggacagagguaucuuggcauagacaucggcgaauacggcauugcguauacugcgcuugagauaacuggcgacagugcaaagauucuugaucaaaauuuuauuucagacccccagcuuaaaacucugcgcgaggaggucaaaggauuaaaacuugaccaaaggcgcgggacauuugccaugccaagcacgaaaaucgcccgcauccgcgaaagccuugugcauaguuugcggaaccgcauacaucaucuugcguuaaagcacaaagcaaagauuguguaugaauuggaagugucgcguuuugaagagggaaagcaaaaaauuaagaaagucuacgcuacguuaaaaaaagcggauguguauucagaaauugacgcggauaaaaauuuacaaacgacaguauggggaaaauuggccguugcaagcgaaaucagcgcaagcuauacaagccaguuuuguggugcguguaaaaaauuguggcgggcggaaaugcagguugacgaaacaauuacaacccaagaacuaaucggcacaguuagagucauaaaagggggcacucuuauugacgcgauaaaggauuuuaugcgcccgccgauuuuugacgaaaaugacacuccauuuccaaaauauagagacuuuugcgacaagcaucacauuuccaaaaaaaugcguggaaacagcuguuuguucauuuguccauucugccgcgcaaacgcggaugcugauauucaagcaagccaaacaauugcgcuuuuaagguauguuaaggaagagaaaaagguagaggacuacuuugaacgauuuagaaagcuaaaaaacauuaaagugcucggacagaugaagaaaauauga

SEQ ID NO: 11128 - RNA, 3681 nt, Artificial Sequence
  CasY variant__Candidatus Vogelbacteria bacterium__OJI07455.1__CasY
augcaaaaaguaagaaaaacuuuaucagagguacauaaaaauccuuaugguacaaaaguccguaaugcaaagacuggcuacucacuacagauagagaggcuuucguauacuggaaaagaggggaugagaaguuuuaagauuccacucgaaaauaaaaauaaagaaguuuuugaugaauucguaaaaaagaucaggaaugauuauaucagucagguuggguugcucaaucuuucugauugguaugaacauuaucaggagaaacaagaacauuauucuuuggcggauuuuugguuagauaguuugagggccggagugauuuuugcgcacaaagaaacugagauaaagaaucuuaucucuaagauacguggugauaaaucgauuguugauaaauuuaaugcaaguauaaagaaaaaacacgccgaucuuuaugcccuugucgauauaaaagcucucuacgauuuucuuaccuccgacgcaagaaggggauuaaagaccgaagaagaauuuuuuaacucaaaaaggaauaccuuguuuccgaaauuuagaaaaaaagauaacaaagccgucgaccuuugggucaaaaaauuuauugggcuggauaauaaagacaaauuaaauuuuaccaaaaaguuuaucgguuucgauccaaauccucagauuaaauaugaccauacuuucuucuuucaucaagacauuaauuuugaucuagagagaaucacgacuccgaaggaacuuauuucgacuuauaagaaauucuuaggaaaaaauaaggaucuauacgguucugaugaaacaacggaagaucaacuuaaaaugguauuagguuuucauaauaaucacggcgcuuuuucuaaguauuucaacgcgagcuuggaagcuuuuagggggagagacaacuccuugguugaacaaauaauuaauaauucuccuuacuggaauagccaucggaaagaauuggaaaagagaaucauuuuuuugcaaguucagucuaaaaaaauaaaagagaccgaacugggaaagccucacgaguaucuugcgaguuuuggcgggaaguuugaaucuuggguuucaaacuauuuacgucaggaagaagaggucaaacgucaacuuuuugguuaugaggagaauaaaaaaggccagaaaaaauuuaucgugggcaacaaacaagagcuagauaaaaucaucagagggacagaugaguaugagauuaaagcgauuucuaaggaaaccauuggacuuacucagaaauguuuaaaauuacuugaacaacuaaaagauagugucgaugauuauacacuuagccuauaucggcaacucauagucgaauugagaaucagacugaauguugaauuccaagaaacuuauccggaauuaaucgguaagagugagaaagauaaagaaaaagaugcgaaaaauaaacgggcagacaagcguuacccgcaaauuuuuaaggauauaaaauuaauccccaauuuucucggugaaacgaaacaaaugguauauaagaaauuuauucguuccgcugacauccuuuaugaaggaauaaauuuuaucgaccagaucgauaaacagauuacucaaaauuuguugccuuguuuuaagaacgacaaggaacggauugaauuuaccgaaaaacaauuugaaacuuuacggcgaaaauacuaucugaugaauaguucccguuuucaccauguuauugaaggaauaaucaauaauaggaaacuuauugaaaugaaaaagagagaaaauagcgaguugaaaacuuucuccgauaguaaguuuguuuuaucuaagcuuuuucuuaaaaaaggcaaaaaauaugaaaaugaggucuauuauacuuuuuauauaaauccgaaagcucgugaccagcgacggauaaaaauuguucuugauauaaaugggaacaauucagucggaauuuuacaagaucuuguccaaaaguugaaaccaaaaugggacgacaucauaaagaaaaaugauaugggagaauuaaucgaugcaaucgagauugagaaaguccggcucggcaucuugauagcguuauacugugagcauaaauucaaaauuaaaaaagaacucuugucauuagauuuguuugccagugccuaucaauaucuagaauuggaagaugacccugaagaacuuucugggacaaaccuaggucgguuuuuacaauccuuggucugcuccgaaauuaaaggugcgauuaauaaaauaagcaggacagaauauauagagcgguauacuguccagccgaugaauacggagaaaaacuauccuuuacucaucaauaaggagggaaaagccacuuggcauauugcugcuaaggaugacuuguccaagaagaagggugggggcacugucgcuaugaaucaaaaaaucggcaagaauuuuuuugggaaacaagauuauaaaacuguguuuaugcuucaggauaagcgguuugaucuacuaaccucaaaguaucacuugcaguuuuuaucuaaaacucuugauacugguggagggucuugguggaaaaacaaaaauauugauuuaaauuuaagcucuuauucuuucauuuucgaacaaaaaguaaaagucgaaugggauuuaaccaaucuugaccauccuauaaagauuaagccuagcgagaacagugaugauagaaggcuuuucguauccauuccuuuuguuauuaaaccgaaacagacaaaaagaaaggauuugcaaacucgagucaauuauauggggauugauaucggagaauaugguuuggcuuggacaauuauuaauauugauuuaaagaauaaaaaaauaaauaagauuucaaaacaagguuucaucuaugagccguugacacauaaagugcgcgauuauguugcuaccauuaaagauaaucagguuagaggaacuuuuggcaugccugauacgaaacuagccagauugcgagaaaaugccauuaccagcuugcgcaaucaagugcaugauauugcuaugcgcuaugacgccaaaccgguauaugaauuugaaauuuccaauuuugaaacggggucuaauaaagugaaaguaauuuaugauucgguuaagcgagcugauaucggccgaggccagaauaauaccgaagcagacaauacugagguuaaucuugucugggggaagacaagcaaacaauuuggcagucaaaucggcgcuuaugcgacaaguuacaucuguucauuuugugguuauucuccauauuaugaauuugaaaauucuaagucgggagaugaagaaggggcuagagauaaucuauaucagaugaagaaauugagucgccccucucuugaagauuuccuccaaggaaauccgguuuauaagacauuuagggauuuugauaaguauaaaaacgaucaacgguugcaaaagacgggugauaaagauggugaauggaaaacacacagagggaauacugcaauauacgccugucaaaaguguagacauaucucugaugcggauauccaagcaucauauuggauugcuuugaagcaaguuguaagagauuuuuauaaagacaaagagauggauggugauuugauucaaggagauaauaaagacaagagaaaaguaaacgagcuuaauagacuuauuggaguacauaaagaugugccuauaauaaauaaaaauuuaauaacaucacucgacauaaacuuacuauag

SEQ ID NO: 11129 - RNA, 3603 nt, Artificial Sequence
  CasY variant__Candidatus Vogelbacteria bacterium__OJI09436.1__CasY
augaaagcuaaaaaaaguuuuuauaaucaaaagcggaaguucgguaaaagagguuaucgucuucacgaugaacguaucgcguauucaggagggauuggaucgaugcgaucuauuaaauaugaauugaaggauucguauggaauugcugggcuucguaaucgaaucgcugacgcaacuauuucugauaauaaguggcuguacgggaauauaaaucuaaaugauuauuuagaguggcgaucuucaaagacugacaaacagauugaagacggagaccgagaaucaucacuccuggguuuuuggcuggaagcguuacgacugggauucguguuuucaaaacaaucucaugcuccgaaugauuuuaacgagaccgcucuacaagauuuguuugaaacucuugaugaugauuugaaacauguucuugauaggaaaaaauggugugacuuuaucaagauaggaacaccuaagacaaaugaccaaggucguuuaaaaaaacaaaucaagaauuuguuaaaaggaaacaagagagaggaaauugaaaaaacucucaaugaaucagacgaugaauugaaagagaaaauaaacagaauugccgauguuuuugcaaaaaauaagucugauaaauacacaauuuucaaauuagauaaacccaauacggaaaaauaccccagaaucaacgauguucagguggcguuuuuuugucaucccgauuuugaggaaauuacagaacgagauagaacaaagacucuagaucugaucauuaaucgguuuaauaagagauaugaaauuaccgaaaauaaaaaagaugacaaaacuucaaacaggauggccuuguauuccuugaaccagggcuauauuccucgcguccugaaugauuuauucuuguuugucaaagacaaugaggaugauuuuagucaguuuuuaucugauuuggagaauuucuucucuuuuuccaacgaacaaauuaaaauaauaaaggaaagguuaaaaaaacuuaaaaaauaugcugaaccaauucccggaaagccgcaacuugcugauaaaugggacgauuaugcuucugauuuuggcgguaaauuggaaagcugguacuccaaucgaauagagaaauuaaagaagauuccggaaagcguuuccgaucugcggaauaauuuggaaaagauacgcaauguuuuaaaaaaacaaaauaaugcaucuaaaauccuggaguuaucucaaaagaucauugaauacaucagagauuauggaguuucuuuugaaaagccggagauaauuaaguucagcuggauaaauaagacgaaggauggucagaaaaaaguuuucuauguugcgaaaauggcggauagagaauucauagaaaagcuugauuuauggauggcugauuuacgcagucaauuaaaugaauacaaucaagauaauaaaguuucuuucaaaaagaaagguaaaaaaauagaagagcucggugucuuggauuuugcucuuaauaaagcgaaaaaaaauaaaaguacaaaaaaugaaaauggcuggcaacaaaaauugucagaaucuauucaaucugccccguuauuuuuuggcgaagggaaucguguacgaaaugaagaaguuuauaauuugaaggaccuucuguuuucagaaaucaagaauguugaaaauauuuuaaugagcucggaagcggaagacuuaaaaaauauaaaaauugaauauaaagaagauggcgcgaaaaaagggaacuaugucuugaaugucuuggcuagauuuuacgcgagauucaaugaggauggcuauggugguuggaacaaaguaaaaaccguuuuggaaaauauugcccgagaggcggggacugauuuuucaaaauauggaaauaauaacaauagaaaugccggcagauuuuaucuaaacggccgcgaacgacaaguuuuuacucuaaucaaguuugaaaaaaguaucacgguggaaaaaauacuugaauugguaaaauuaccuagccuacuugaugaagcguauagagauuuagucaacgaaaauaaaaaucauaaauuacgcgacguaauucaauugagcaagacaauuauggcucugguuuuaucucauucugauaaagaaaaacaaauuggaggaaauuauauccauaguaaauugagcggauacaaugcgcuuauuucaaagcgagauuuuaucucgcgguauagcgugcaaacgaccaacggaacucaauguaaauuagccauaggaaaaggcaaaagcaaaaaagguaaugaaauugacagguauuucuacgcuuuucaauuuuuuaagaaugacgacagcaaaauuaauuuaaagguaaucaaaaauaauucgcauaaaaacaucgauuucaacgacaaugaaaauaaaauuaacgcauugcaaguguauucaucaaacuaucagauucaauucuuagacugguuuuuugaaaaacaucaagggaagaaaacaucgcucgaggucggcggaucuuuuaccaucgccgaaaagaguuugacaauagacuggucggggaguaauccgagagucgguuuuaaaagaagcgacacggaagaaaagaggguuuuugucucgcaaccauuuacauuaauaccagacgaugaagacaaagagcgucguaaagaaagaaugauaaagacgaaaaaccguuuuaucgguaucgauaucggugaauauggucuggcuuggagucuaaucgaaguggacaauggagauaaaaauaauagaggaauuagacaacuugagagcgguuuuauuacagacaaucagcagcaagucuuaaagaaaaacguaaaauccuggaggcaaaaccaaauucgucaaacguuuacuucaccagacacaaaaauugcucgucuucgugaaaguuugaucggaaguuacaaaaaucaacuggaaagucugaugguugcuaaaaaagcaaaucuuaguuuugaauacgaaguuuccggguuugaaguugggggaaagaggguugcaaaaauauacgauaguauaaagcgugggucggugcguaaaaaggauaauaacucacaaaaugaucaaaguugggguaaaaagggaauuaaugaguggucauucgagacgacggcugccggaacaucgcaauuuuguacucauugcaagcgguggagcaguuuagcgauaguagauauugaagaauaugaauuaaaagauuacaacgauaauuuauuuaagguaaaaauuaaugauggugaaguucgucuccuugguaagaaagguuggagauccggcgaaaagaucaaagggaaagaauuauuuggucccgucaaagacgcaaugcgcccaaauguugacggacuagggaugaaaauuguaaaaagaaaauaucuaaaacuugaucuccgcgauuggguuucaagauaugggaauauggcuauuuucaucuguccuuaugucgauugccaccauaucucucaugcggauaaacaagcugcuuuuaauauugccgugcgaggguauuugaaaagcguuaauccugacagagcaauaaaacacggagauaaagguuugucuagggacuuuuugugccaagaagaggguaagcuuaauuuugaacaaauaggguuauuauga

SEQ ID NO: 11130 - RNA, 3462 nt, Artificial Sequence
  CasY variant__Candidatus Vogelbacteria bacterium__PIP58309.1__CasY
augcaaaaaguaagaaaaacuuuaucagagguacauaaaaauccuuaugguacaaaaguccguaaugcaaagacuggcuacucacuacagauagagaggcuuucguauacuggaaaagaggggaugagaaguuuuaagauuccacucgaaaauaaaaauaaagaaguuuuugaugaauucguaaaaaagaucaggaaugauuauaucagucagguuggguugcucaaucuuucugauugguaugaacauuaucaggagaaacaagaacauuauucuuuggcggauuuuugguuagauaguuugagggccggagugauuuuugcgcacaaagaaacugagauaaagaaucuuaucucuaagauacguggugauaaaucgauuguugauaaauuuaaugcaaguauaaagaaaaaacacgccgaucuuuaugcccuugucgauauaaaagcucucuacgauuuucuuaccuccgacgcaagaaggggauuaaagaccgaagaagaauuuuuuaacucaaaaaggaauaccuuguuuccgaaauuuagaaaaaaagauaacaaagccgucgaccuuugggucaaaaaauuuauugggcuggauaauaaagacaaauuaaauuuuaccaaaaaguuuaucgguuucgauccaaauccucagauuaaauaugaccauacuuucuucuuucaucaagacauuaauuuugaucuagagagaaucacgacuccgaaggaacuuauuucgacuuauaagaaauucuuaggaaaaaauaaggaucuauacgguucugaugaaacaacggaagaucaacuuaaaaugguauuagguuuucauaauaaucacggcgcuuuuucuaaguauuucaacgcgagcuuggaagcuuuuagggggagagacaacuccuugguugaacaaauaauuaauaauucuccuuacuggaauagccaucggaaagaauuggaaaagagaaucauuuuuuugcaaguucagucuaaaaaaauaaaagagaccgaacugggaaagccucacgaguaucuugcgaguuuuggcgggaaguuugaaucuuggguuucaaacuauuuacgucaggaagaagaggucaaacgucaacuuuuugguuaugaggagaauaaaaaaggccagaaaaaauuuaucgugggcaacaaacaagagcuagauaaaaucaucagagggacagaugaguaugagauuaaagcgauuucuaaggaaaccauuggacuuacucagaaauguuuaaaauuacuugaacaacuaaaagauagugucgaugauuauacacuuagccuauaucggcaacucauagucgaauugagaaucagacugaauguugaauuccaagaaacuuauccggaauuaaucgguaagagugagaaagauaaagaaaaagaugcgaaaaauaaacgggcagacaagcguuacccgcaaauuuuuaaggauauaaaauuaauccccaauuuucucggugaaacgaaacaaaugguauauaagaaauuuauucguuccgcugacauccuuuaugaaggaauaaauuuuaucgaccagaucgauaaacagauuacucaaaauuuguugccuuguuuuaagaacgacaaggaacggauugaauuuaccgaaaaacaauuugaaacuuuacggcgaaaauacuaucugaugaauaguucccguuuucaccauguuauugaaggaauaaucaauaauaggaaacuuauugaaaugaaaaagagagaaaauagcgaguugaaaacuuucuccgauaguaaguuuguuuuaucuaagcuuuuucuuaaaaaaggcaaaaaauaugaaaaugaggucuauuauacuuuuuauauaaauccgaaagcucgugaccagcgacggauaaaaauuguucuugauauaaaugggaacaauucagucggaauuuuacaagaucuuguccaaaaguugaaaccaaaaugggacgacaucauaaagaaaaaugauaugggagaauuaaucgaugcaaucgagauugagaaaguccggcucggcaucuugauagcguuauacugugagcauaaauucaaaauuaaaaaagaacucuugucauuagauuuguuugccagugccuaucaauaucuagaauuggaagaugacccugaagaacuuucugggacaaaccuaggucgguuuuuacaauccuuggucugcuccgaaauuaaaggugcgauuaauaaaauaagcaggacagaauauauagagcgguauacuguccagccgaugaauacggagaaaaacuauccuuuacucaucaauaaggagggaaaagccacuuggcauauugcugcuaaggaugacuuguccaagaagaagggugggggcacugucgcuaugaaucaaaaaaucggcaagaauuuuuuugggaaacaagauuauaaaacuguguuuaugcuucaggauaagcgguuugaucuacuaaccucaaaguaucacuugcaguuuuuaucuaaaacucuugauacugguggagggucuugguggaaaaacaaaaauauugauuuaaauuuaagcucuuauucuuucauuuucgaacaaaaaguaaaagucgaaugggauuuaaccaaucuugaccauccuauaaagauuaagccuagcgagaacagugaugauagaaggcuuuucguauccauuccuuuuguuauuaaaccgaaacagacaaaaagaaaggauuugcaaacucgagucaauuauauggggauugauaucggagaauaugguuuggcuuggacaauuauuaauauugauuuaaagaauaaaaaaauaaauaagauuucaaaacaagguuucaucuaugagccguugacacauaaagugcgcgauuauguugcuaccauuaaagauaaucagguuagaggaacuuuuggcaugccugauacgaaacuagccagauugcgagaaaaugccauuaccagcuugcgcaaucaagugcaugauauugcuaugcgcuaugacgccaaaccgguauaugaauuugaaauuuccaauuuugaaacggggucuaauaaagugaaaguaauuuaugauucgguuaagcgagcugauaucggccgaggccagaauaauaccgaagcagacaauacugagguuaaucuugucugggggaagacaagcaaacaauuuggcagucaaaucggcgcuuaugcgacaaguuacaucuguucauuuugugguuauucuccauauuaugaauuugaaaauucuaagucgggagaugaagaaggggcuagagauaaucuauaucagaugaagaaauugagucgccccucucuugaagauuuccuccaaggaaauccgguuuauaagacauuuagggauuuugauaaguauaaaaacgaucaacgguugcaaaagacgggugauaaagauggugaauggaaaacacacagagggaauacugcaauauacgccugucaaaaguguuga

SEQ ID NO: 11131 - RNA, 3480 nt, Artificial Sequence
  Cas13a variant__Leptotrichia buccalis__WP_015770004.1__Cas13a
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcaagcugaagaacgccgugaugaaguccguggucgacauccucaaggaguacggguucguggcgacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11132 - RNA, 3480 nt, Artificial Sequence
  Cas13a variant__Leptotrichia buccalis__WP_015770004.1__Cas13a(R472A,H477A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcaucgcccacggcaucguggcguucaaccucgagcuggaggggaaggacaucuucgccuucaagaacaucgcccccuccgagaucagcaagaagauguuccagaacgagaucaacgagaagaagcugaagcucaagaucuuccgccagcugaacuccgccaacgucuuccgcuaccuggagaaguacaagauccucaacuaccugaagcggacccgcuucgaguucgugaacaagaacauccccuucguccccagcuucacgaagcuguacucccggaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcgcaaccugaagacgggcuucuacaagcuccagaaguucgaggacauccaggagaagauccccaaggaguaccuggcgaacauccagucccuguacaugaucaacgccgggaaccaggacgaggaggagaaggacaccuacaucgacuucauccagaagaucuuccucaagggcuucaugaccuaccuggccaacaacgggcggcugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgcgagaucaagcuggggaacauccugaaguacaccgagcggcucaacauguucuaccugauccugaagcuccugaaccacaaggagcugaccaaccucaagggcagccuggagaaguaccaguccgccaacaaggaggaggcguucagcgaccagcuggagcucaucaaccugcugaaccucgacaacaaccgcgugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgggccuucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccgcaaguacgcgcggccccgcaaggacgagaaguucaccgacgaggacuacgaguccuacaagcaggccaucgagaacaucgaggaguacacccaccucaagaacaaggucgaguucaacgagcugaaccugcuccaggggcugcugcuccggauccugcaccgccuggugggcuacaccagcaucugggagcgggaccuccgcuuccggcugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgccaacaucaaggugcucaagcaggagaagaaggaccuguacauccgcaacuacaucgcccacuucaacuacaucccccacgcggagaucucccugcucgagguccuggagaaccugcggaagcuccugagcuacgaccgcaagcugaagaacgccgugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccgcaacuccgaggagcugugcaagcucgucaagaucauguucgaguacaagauggaggagaagaaguccgagaacuga

SEQ ID NO: 11133 - RNA, 3480 nt, Artificial Sequence
  Cas13a variant__Leptotrichia buccalis__WP_015770004.1__Cas13a(R1048A,H1053A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacaucgccaacuacaucgccgccuucaacuacaucccccacgcggagaucucccugcucgagguccuggagaaccugcggaagcuccugagcuacgaccgcaagcugaagaacgccgugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccgcaacuccgaggagcugugcaagcucgucaagaucauguucgaguacaagauggaggagaagaaguccgagaacuga

SEQ ID NO: 11134 - RNA, 3480 nt, Artificial Sequence
  Cas13a variant__Leptotrichia buccalis__WP_015770004.1__Cas13a(R472A,H477A,R1048A,H1053A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcaucgcccacggcaucguggcguucaaccucgagcuggaggggaaggacaucuucgccuucaagaacaucgcccccuccgagaucagcaagaagauguuccagaacgagaucaacgagaagaagcugaagcucaagaucuuccgccagcugaacuccgccaacgucuuccgcuaccuggagaaguacaagauccucaacuaccugaagcggacccgcuucgaguucgugaacaagaacauccccuucguccccagcuucacgaagcuguacucccggaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcgcaaccugaagacgggcuucuacaagcuccagaaguucgaggacauccaggagaagauccccaaggaguaccuggcgaacauccagucccuguacaugaucaacgccgggaaccaggacgaggaggagaaggacaccuacaucgacuucauccagaagaucuuccucaagggcuucaugaccuaccuggccaacaacgggcggcugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgcgagaucaagcuggggaacauccugaaguacaccgagcggcucaacauguucuaccugauccugaagcuccugaaccacaaggagcugaccaaccucaagggcagccuggagaaguaccaguccgccaacaaggaggaggcguucagcgaccagcuggagcucaucaaccugcugaaccucgacaacaaccgcgugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgggccuucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccgcaaguacgcgcggccccgcaaggacgagaaguucaccgacgaggacuacgaguccuacaagcaggccaucgagaacaucgaggaguacacccaccucaagaacaaggucgaguucaacgagcugaaccugcuccaggggcugcugcuccggauccugcaccgccuggugggcuacaccagcaucugggagcgggaccuccgcuuccggcugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgccaacaucaaggugcucaagcaggagaagaaggaccuguacaucgccaacuacaucgcggccuucaacuacaucccccacgccgagaucucccugcucgagguccuggagaaccugcgcaagcuccugagcuacgaccggaagcugaagaacgccgugaugaaguccguggucgacauccucaaggaguacggguucguggccacguucaagaucggcgcggacaagaagaucgggauccagacccuggagagcgagaagaucgugcaccugaagaaccucaagaagaagaagcugaugaccgaccgcaacuccgaggagcugugcaagcucgucaagaucauguucgaguacaagauggaggagaagaaguccgagaacuga

SEQ ID NO: 11135 - RNA, 3480 nt, Artificial Sequence
  Cas13a variant__Leptotrichia buccalis__WP_015770004.1__Cas13a(R1079A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgacgccaagcugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccgcaacuccgaggagcugugcaagcucgucaagaucauguucgaguacaagauggaggagaagaaguccgagaacuga

SEQ ID NO: 11136 - RNA, 3480 nt, Artificial Sequence
  Cas13a variant__Leptotrichia buccalis__WP_015770004.1__Cas13a(E299A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgccaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcgcgcaaccggcagaacgaggccuuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgcguucaagaacaucgcccccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgcggggaaccaggacgaggaggagaaggacaccuacaucgacuucauccagaagaucuuccucaagggcuucaugaccuaccuggccaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggcggacgagaucggcaaguuccuggacuucaacgggaacaaggugaaggacaacaaggagcucaagaaguucgacacgaacaagaucuacuucgacggcgagaacaucaucaagcaccgcgccuucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggcgaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgccaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcaagcugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11137 - RNA, 3480 nt, Artificial Sequence
  Cas13a variant__Leptotrichia buccalis__WP_015770004.1__Cas13a(K310A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacgcccggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcgcgcaaccggcagaacgaggccuuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgcguucaagaacaucgcccccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgcggggaaccaggacgaggaggagaaggacaccuacaucgacuucauccagaagaucuuccucaagggcuucaugaccuaccuggccaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggcggacgagaucggcaaguuccuggacuucaacgggaacaaggugaaggacaacaaggagcucaagaaguucgacacgaacaagaucuacuucgacggcgagaacaucaucaagcaccgcgccuucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggcgaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgccaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcaagcugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11138 - RNA, 3480 nt, Artificial Sequence
  Cas13a variant__Leptotrichia buccalis__WP_015770004.1__Cas13a(N314A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcgccaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcgcgcaaccggcagaacgaggccuuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgcguucaagaacaucgcccccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgcggggaaccaggacgaggaggagaaggacaccuacaucgacuucauccagaagaucuuccucaagggcuucaugaccuaccuggccaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggcggacgagaucggcaaguuccuggacuucaacgggaacaaggugaaggacaacaaggagcucaagaaguucgacacgaacaagaucuacuucgacggcgagaacaucaucaagcaccgcgccuucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggcgaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgccaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcaagcugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11139 - RNA, 3480 nt, Artificial Sequence
  Cas13a variant__Leptotrichia buccalis__WP_015770004.1__Cas13a(R1072A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccuggccaagcuccugagcuacgaccgcaagcugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccgcaacuccgaggagcugugcaagcucgucaagaucauguucgaguacaagauggaggagaagaaguccgagaacuga

SEQ ID NO: 11140 - RNA, 3480 nt, Artificial Sequence
  Cas13a variant__Leptotrichia buccalis__WP_015770004.1__Cas13a(D1078A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgcccgcaagcugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11141 - RNA, 3480 nt, Artificial Sequence
  Cas13a variant__Leptotrichia buccalis__WP_015770004.1__Cas13a(R1079A,K1080A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgacgccgcgcugaagaacgccgugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccgcaacuccgaggagcugugcaagcucgucaagaucauguucgaguacaagauggaggagaagaaguccgagaacuga

SEQ ID NO: 11142 - RNA, 3480 nt, Artificial Sequence
  Cas13a variant__Leptotrichia buccalis__WP_015770004.1__Cas13a(K1080A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcgcccugaagaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11143 - RNA, 3480 nt, Artificial Sequence
  Cas13a variant__Leptotrichia buccalis__WP_015770004.1__Cas13a(K1082A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcaagcuggccaacgcggugaugaaguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11144 - RNA, 3480 nt, Artificial Sequence
  Cas13a variant__Leptotrichia buccalis__WP_015770004.1__Cas13a(K1087A)
augaaggugaccaaggucggcgggaucagccacaagaaguacaccagcgagggccgccuggucaagagcgaguccgaggagaaccggacggacgagcgccucagcgcccugcugaacaugcggcucgacauguacaucaagaaccccuccagcaccgagaccaaggagaaccagaagcgcaucgggaagcugaagaaguucuucuccaacaagaugguguaccugaaggacaacacccucagccugaagaacggcaagaaggagaacaucgaccgggaguacuccgagacggacauccuggagagcgacgugcgcgacaagaagaacuucgccgugcucaagaagaucuaccugaacgagaacgugaacuccgaggagcuggaggucuuccggaacgacaucaagaagaagcucaacaagaucaacagccugaaguacuccuucgagaagaacaaggcgaacuaccagaagaucaacgagaacaacaucgagaagguggagggcaagagcaagcgcaacaucaucuacgacuacuaccgggaguccgccaagcgcgacgccuacgugagcaacgucaaggaggccuucgacaagcuguacaaggaggaggacaucgccaagcucgugcuggagaucgagaaccugaccaagcucgagaaguacaagauccgggaguucuaccacgagaucaucgggcgcaagaacgacaaggagaacuucgcgaagaucaucuacgaggagauccagaacgugaacaacaugaaggagcugaucgagaaggucccggacauguccgagcugaagaagucccagguguucuacaaguacuaccucgacaaggaggagcugaacgacaagaacaucaaguacgccuucugccacuucguggagaucgagaugagccagcugcucaagaacuacgucuacaagcggcugagcaacaucagcaacgacaagaucaagcgcaucuucgaguaccagaaccugaagaagcucaucgagaacaagcugcugaacaagcucgacaccuacgugcggaacugcggcaaguacaacuacuaccugcaggacggggagaucgccaccuccgacuucaucgcccgcaaccggcagaacgaggcguuccugcgcaacaucaucggcgugagcuccgucgccuacuucagccuccggaacauccuggagacggagaacgagaacgacaucaccgggcgcaugcggggcaagaccgugaagaacaacaagggggaggagaaguacguguccggcgaggucgacaagaucuacaacgagaacaagaagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggaggggaaggacaucuucgccuucaagaacaucgcgcccuccgagaucagcaagaagauguuccagaacgagaucaacgagaagaagcugaagcucaagaucuuccgccagcugaacuccgccaacgucuuccgguaccuggagaaguacaagauccucaacuaccugaagcgcacccgguucgaguucgugaacaagaacauccccuucguccccagcuucacgaagcuguacucccgcaucgacgaccucaagaacagccugggcaucuacuggaagaccccgaagaccaacgacgacaacaagaccaaggagaucaucgacgcccagaucuaccugcucaagaacaucuacuacggggaguuccugaacuacuucauguccaacaacggcaacuucuucgagaucagcaaggagaucaucgagcugaacaagaacgacaagcggaaccugaagacgggcuucuacaagcuccagaaguucgaggacauccaggagaagauccccaaggaguaccuggccaacauccagucccuguacaugaucaacgccgggaaccaggacgaggaggagaaggacaccuacaucgacuucauccagaagaucuuccucaagggcuucaugaccuaccuggcgaacaacgggcgccugagccucaucuacaucggcuccgacgaggagaccaacacgagccuggccgagaagaagcaggaguucgacaaguuccugaagaaguacgagcagaacaacaacaucaagauccccuacgagaucaacgaguuccuccgggagaucaagcuggggaacauccugaaguacaccgagcgccucaacauguucuaccugauccugaagcuccugaaccacaaggagcugaccaaccucaagggcagccuggagaaguaccaguccgccaacaaggaggaggccuucagcgaccagcuggagcucaucaaccugcugaaccucgacaacaaccgggugaccgaggacuucgagcuggaggccgacgagaucggcaaguuccuggacuucaacgggaacaaggugaaggacaacaaggagcucaagaaguucgacacgaacaagaucuacuucgacggcgagaacaucaucaagcaccgcgcguucuacaacaucaagaaguacgggaugcugaaccugcucgagaagaucgccgacaaggccggcuacaagaucuccaucgaggagcugaagaaguacagcaacaagaagaacgagaucgagaagaaccacaagaugcaggagaaccugcaccggaaguacgcccgcccccggaaggacgagaaguucaccgacgaggacuacgaguccuacaagcaggccaucgagaacaucgaggaguacacccaccucaagaacaaggucgaguucaacgagcugaaccugcuccaggggcugcugcuccgcauccugcaccggcuggugggcuacaccagcaucugggagcgcgaccuccgguuccgccugaagggcgaguucccggagaaccaguacaucgaggagaucuucaacuucgagaacaagaagaacgugaaguacaagggcgggcagaucgucgagaaguacaucaaguucuacaaggagcugcaccagaacgacgaggugaagaucaacaaguacuccagcgcgaacaucaaggugcucaagcaggagaagaaggaccuguacauccggaacuacaucgcccacuucaacuacaucccccacgccgagaucucccugcucgagguccuggagaaccugcgcaagcuccugagcuacgaccgcaagcugaagaacgccgugauggcguccguggucgacauccucaaggaguacggguucguggccacguucaagaucggcgccgacaagaagaucgggauccagacccuggagagcgagaagaucgugcaccugaagaaccucaagaagaagaagcugaugaccgaccggaacuccgaggagcugugcaagcucgucaagaucauguucgaguacaagauggaggagaagaaguccgagaacuga

SEQ ID NO: 11145 - RNA, 4170 nt, Artificial Sequence
  Cas13a variant__Leptotrichia shahii__WP_018451595.1__Cas13a
augggcaaccuguucgggcacaagcgcugguacgaggugcgggacaagaaggacuucaagaucaagcgcaaggucaaggugaagcggaacuacgacggcaacaaguacauccucaacaucaacgagaacaacaacaaggagaagaucgacaacaacaaguucauccgcaaguacaucaacuacaagaagaacgacaacauccugaaggaguucacccggaaguuccacgccgggaacauccuguucaagcucaagggcaaggaggggaucauccgcaucgagaacaacgacgacuuccuggagaccgaggaggugguccuguacaucgaggccuacggcaagagcgagaagcucaaggcgcugggcaucacgaagaagaagaucaucgacgaggccauccggcaggggaucaccaaggacgacaagaagaucgagaucaagcgccaggagaacgaggaggagaucgagaucgacauccgggacgaguacaccaacaagacccugaacgacugcuccaucauccuccgcaucaucgagaacgacgagcuggagacgaagaaguccaucuacgagaucuucaagaacaucaacaugagccuguacaagaucaucgagaagaucaucgagaacgagaccgagaagguguucgagaaccgguacuacgaggagcaccuccgcgagaagcugcugaaggacgacaagaucgacgugauccucaccaacuucauggagauccgggagaagaucaagagcaaccuggagauccugggcuucgucaaguucuaccucaacgucgggggcgacaagaagaaguccaagaacaagaagaugcugguggagaagauccugaacaucaacguggaccucaccguggaggacaucgccgacuucgugaucaaggagcuggaguucuggaacaucacgaagcgcaucgagaaggucaagaaggugaacaacgaguuccuggagaagcggcgcaaccggaccuacaucaagagcuacgugcuccuggacaagcacgagaaguucaagaucgagcgcgagaacaagaaggacaagaucgucaaguucuucguggagaacaucaagaacaacuccaucaaggagaagaucgagaagauccuggccgaguucaagaucgacgagcucaucaagaagcuggagaaggagcugaagaaggggaacugcgacaccgagaucuucggcaucuucaagaagcacuacaaggugaacuucgacagcaagaaguucuccaagaaguccgacgaggagaaggagcucuacaagaucaucuaccgguaccugaagggccgcaucgagaagauccuggucaacgagcagaaggugcggcucaagaagauggagaagaucgagaucgagaagauccugaacgagagcauccugagcgagaagauccucaagcgcgugaagcaguacacccuggagcacaucauguaccuggggaagcuccgccacaacgacaucgacaugacgaccgucaacaccgacgacuucucccggcugcacgccaaggaggagcuggaccucgagcugaucaccuucuucgcgagcacgaacauggagcugaacaagaucuucucccgcgagaacaucaacaacgacgagaacaucgacuucuucggcggggaccgggagaagaacuacgugcucgacaagaagauccugaacagcaagaucaagaucauccgcgaccuggacuucaucgacaacaagaacaacaucaccaacaacuucauccggaaguucaccaagaucggcaccaacgagcgcaaccggauccuccacgccaucuccaaggagcgcgaccugcagggcacgcaggacgacuacaacaaggugaucaacaucauccagaaccugaagaucagcgacgaggaggucuccaaggcccugaaccucgacguggucuucaaggacaagaagaacaucaucaccaagaucaacgacaucaagaucagcgaggagaacaacaacgacaucaaguaccugcccagcuucuccaaggugcugccggagauccucaaccuguaccggaacaaccccaagaacgagcccuucgacaccaucgagaccgagaagaucgugcugaacgcccucaucuacgucaacaaggagcuguacaagaagcugauccucgaggacgaccuggaggagaacgagagcaagaacaucuuccugcaggagcucaagaagacgcuggggaacaucgacgagaucgacgagaacaucaucgagaacuacuacaagaacgcgcagaucuccgccagcaagggcaacaacaaggccaucaagaaguaccagaagaaggugaucgagugcuacaucggguaccugcgcaagaacuacgaggagcuguucgacuucuccgacuucaagaugaacauccaggagaucaagaagcagaucaaggacaucaacgacaacaagaccuacgagcggaucaccgugaagaccagcgacaagacgaucgucaucaacgacgacuucgaguacaucaucuccaucuucgcccuccugaacagcaacgccgugaucaacaagauccgcaaccgguucuucgcgaccuccguguggcucaacaccagcgaguaccagaacaucaucgacauccuggacgagaucaugcagcugaacacccuccgcaacgagugcaucacggagaacuggaaccugaaccuggaggaguucauccagaagaugaaggagaucgagaaggacuucgacgacuucaagauccagaccaagaaggagaucuucaacaacuacuacgaggacaucaagaacaacauccucaccgaguucaaggacgacaucaacggcugcgacguccuggagaagaagcuggagaagaucgugaucuucgacgacgagaccaaguucgagaucgacaagaaguccaacauccuccaggacgagcagcggaagcugagcaacaucaacaagaaggaccugaagaagaagguggaccaguacaucaaggacaaggaccaggagaucaaguccaagauccucugccgcaucaucuucaacagcgacuuccugaagaaguacaagaaggagaucgacaaccugaucgaggacauggaguccgagaacgagaacaaguuccaggagaucuacuaccccaaggagcggaagaacgagcucuacaucuacaagaagaaccuguuccugaacaucgggaacccgaacuucgacaagaucuacggccucaucagcaacgacaucaagauggccgacgccaaguuccuguucaacaucgacggcaagaacauccgcaagaacaagaucuccgagaucgacgccauccugaagaaccucaacgacaagcugaacggguacagcaaggaguacaaggagaaguacaucaagaagcugaaggagaacgacgacuucuucgccaagaacauccagaacaagaacuacaaguccuucgagaaggacuacaaccgggucagcgaguacaagaagauccgcgaccucguggaguucaacuaccugaacaagaucgagagcuaccugaucgacaucaacuggaagcucgcgauccagauggcccgcuucgagcgggacaugcacuacaucgugaacggccugcgcgagcuggggaucaucaagcucuccggcuacaacacggggaucagccgggccuaccccaagcgcaacggcuccgacggcuucuacaccaccaccgccuacuacaaguucuucgacgaggagagcuacaagaaguucgagaagaucugcuacggguucggcaucgaccuguccgagaacagcgagaucaacaagcccgagaacgaguccauccggaacuacaucagccacuucuacaucguccgcaaccccuucgccgacuacuccaucgcggagcagaucgaccgggugagcaaccugcucuccuacagcacccgcuacaacaacuccacguacgccagcguguucgaggucuucaagaaggacgugaaccuggacuacgacgagcugaagaagaaguucaagcucaucgggaacaacgacauccuggagcggcugaugaagccgaagaagguguccguccucgagcuggagagcuacaacuccgacuacaucaagaaccugaucaucgagcuccugaccaagaucgagaacaccaacgacacccuguga

SEQ ID NO: 11146 - RNA, 4170 nt, Artificial Sequence; identical to SEQ ID NO: 11145
  Cas13a variant__Leptotrichia shahii__WP_018451595.1__Cas13a

SEQ ID NO: 11147 - RNA, 4305 nt, Artificial Sequence
  Cas13a variant__Leptotrichia shahii__WP_018451595.1__Cas13a(long)
augggcaaccuguucgggcacaagcgcugguacgaggugcgggacaagaaggacuucaagaucaagcgcaaggucaaggugaagcggaacuacgacggcaacaaguacauccucaacaucaacgagaacaacaacaaggagaagaucgacaacaacaaguucauccgcaaguacaucaacuacaagaagaacgacaacauccugaaggaguucacccggaaguuccacgccgggaacauccuguucaagcucaagggcaaggaggggaucauccgcaucgagaacaacgacgacuuccuggagaccgaggaggugguccuguacaucgaggccuacggcaagagcgagaagcucaaggcgcugggcaucacgaagaagaagaucaucgacgaggccauccggcaggggaucaccaaggacgacaagaagaucgagaucaagcgccaggagaacgaggaggagaucgagaucgacauccgggacgaguacaccaacaagacccugaacgacugcuccaucauccuccgcaucaucgagaacgacgagcuggagacgaagaaguccaucuacgagaucuucaagaacaucaacaugagccuguacaagaucaucgagaagaucaucgagaacgagaccgagaagguguucgagaaccgguacuacgaggagcaccuccgcgagaagcugcugaaggacgacaagaucgacgugauccucaccaacuucauggagauccgggagaagaucaagagcaaccuggagauccugggcuucgucaaguucuaccucaacgucgggggcgacaagaagaaguccaagaacaagaagaugcugguggagaagauccugaacaucaacguggaccucaccguggaggacaucgccgacuucgugaucaaggagcuggaguucuggaacaucacgaagcgcaucgagaaggucaagaaggugaacaacgaguuccuggagaagcggcgcaaccggaccuacaucaagagcuacgugcuccuggacaagcacgagaaguucaagaucgagcgcgagaacaagaaggacaagaucgucaaguucuucguggagaacaucaagaacaacuccaucaaggagaagaucgagaagauccuggccgaguucaagaucgacgagcucaucaagaagcuggagaaggagcugaagaaggggaacugcgacaccgagaucuucggcaucuucaagaagcacuacaaggugaacuucgacagcaagaaguucuccaagaaguccgacgaggagaaggagcucuacaagaucaucuaccgguaccugaagggccgcaucgagaagauccuggucaacgagcagaaggugcggcucaagaagauggagaagaucgagaucgagaagauccugaacgagagcauccugagcgagaagauccucaagcgcgugaagcaguacacccuggagcacaucauguaccuggggaagcuccgccacaacgacaucgacaugacgaccgucaacaccgacgacuucucccggcugcacgccaaggaggagcuggaccucgagcugaucaccuucuucgcgagcacgaacauggagcugaacaagaucuucucccgcgagaacaucaacaacgacgagaacaucgacuucuucggcggggaccgggagaagaacuacgugcucgacaagaagauccugaacagcaagaucaagaucauccgcgaccuggacuucaucgacaacaagaacaacaucaccaacaacuucauccggaaguucaccaagaucggcaccaacgagcgcaaccggauccuccacgccaucuccaaggagcgcgaccugcagggcacgcaggacgacuacaacaaggugaucaacaucauccagaaccugaagaucagcgacgaggaggucuccaaggcccugaaccucgacguggucuucaaggacaagaagaacaucaucaccaagaucaacgacaucaagaucagcgaggagaacaacaacgacaucaaguaccugcccagcuucuccaaggugcugccggagauccucaaccuguaccggaacaaccccaagaacgagcccuucgacaccaucgagaccgagaagaucgugcugaacgcccucaucuacgucaacaaggagcuguacaagaagcugauccucgaggacgaccuggaggagaacgagagcaagaacaucuuccugcaggagcucaagaagacgcuggggaacaucgacgagaucgacgagaacaucaucgagaacuacuacaagaacgcgcagaucuccgccagcaagggcaacaacaaggccaucaagaaguaccagaagaaggugaucgagugcuacaucggguaccugcgcaagaacuacgaggagcuguucgacuucuccgacuucaagaugaacauccaggagaucaagaagcagaucaaggacaucaacgacaacaagaccuacgagcggaucaccgugaagaccagcgacaagacgaucgucaucaacgacgacuucgaguacaucaucuccaucuucgcccuccugaacagcaacgccgugaucaacaagauccgcaaccgguucuucgcgaccuccguguggcucaacaccagcgaguaccagaacaucaucgacauccuggacgagaucaugcagcugaacacccuccgcaacgagugcaucacggagaacuggaaccugaaccuggaggaguucauccagaagaugaaggagaucgagaaggacuucgacgacuucaagauccagaccaagaaggagaucuucaacaacuacuacgaggacaucaagaacaacauccucaccgaguucaaggacgacaucaacggcugcgacguccuggagaagaagcuggagaagaucgugaucuucgacgacgagaccaaguucgagaucgacaagaaguccaacauccuccaggacgagcagcggaagcugagcaacaucaacaagaaggaccugaagaagaagguggaccaguacaucaaggacaaggaccaggagaucaaguccaagauccucugccgcaucaucuucaacagcgacuuccugaagaaguacaagaaggagaucgacaaccugaucgaggacauggaguccgagaacgagaacaaguuccaggagaucuacuaccccaaggagcggaagaacgagcucuacaucuacaagaagaaccuguuccugaacaucgggaacccgaacuucgacaagaucuacggccucaucagcaacgacaucaagauggccgacgccaaguuccuguucaacaucgacggcaagaacauccgcaagaacaagaucuccgagaucgacgccauccugaagaaccucaacgacaagcugaacggguacagcaaggaguacaaggagaaguacaucaagaagcugaaggagaacgacgacuucuucgccaagaacauccagaacaagaacuacaaguccuucgagaaggacuacaaccgggucagcgaguacaagaagauccgcgaccucguggaguucaacuaccugaacaagaucgagagcuaccugaucgacaucaacuggaagcucgcgauccagauggcccgcuucgagcgggacaugcacuacaucgugaacggccugcgcgagcuggggaucaucaagcucuccggcuacaacacggggaucagccgggccuaccccaagcgcaacggcuccgacggcuucuacaccaccaccgccuacuacaaguucuucgacgaggagagcuacaagaaguucgagaagaucugcuacggguucggcaucgaccuguccgagaacagcgagaucaacaagcccgagaacgaguccauccggaacuacaucagccacuucuacaucguccgcaaccccuucgccgacuacuccaucgcggagcagaucgaccgggugagcaaccugcucuccuacagcacccgcuacaacaacuccacguacgccagcguguucgaggucuucaagaaggacgugaaccuggacuacgacgagcugaagaagaaguucaagcucaucgggaacaacgacauccuggagcggcugaugaagccgaagaagguguccguccucgagcuggagagcuacaacuccgacuacaucaagaaccugaucaucgagcuccugaccaagaucgagaacaccaacgacacccugaagcgccccgccgccacgaagaaggccggccaggcgaagaagaagaaggggagcuaccccuacgacgugcccgacuacgccuacccguacgacgugcccgacuacgccuaccccuacgacguccccgacuacgccuga

SEQ ID NO: 11148 - RNA, 4158 nt, Artificial Sequence
  Cas13a variant__Leptotrichia sp. oral__WP_021744063.1__Cas13a
augggcaaccuguucgggcacaagcgcugguacgaggugcgggacaagaaggacuucaagaucaagcgcaaggucaaggugaagcggaacuacgacggcaacaaguacauccucaacaucaacgagaacaacaacaaggagaagaucgacaacaacaaguucaucggggaguucgugaacuacaagaagaacaacaacguccugaaggaguucaagcgcaaguuccacgccggcaacauccuguucaagcucaaggggaaggaggagaucauccggaucgagaacaacgacgacuuccuggagaccgaggagguggugcuguacaucgaggucuacggcaagagcgagaagcucaaggcccuggagaucaccaagaagaagaucaucgacgaggcgauccgccagggcaucacgaaggacgacaagaagaucgagaucaagcggcaggagaacgaggaggagaucgagaucgacauccgcgacgaguacaccaacaagacccugaacgacugcuccaucauccuccggaucaucgagaacgacgagcuggagaccaagaaguccaucuacgagaucuucaagaacaucaacaugagccuguacaagaucaucgagaagaucaucgagaacgagacggagaagguguucgagaaccgcuacuacgaggagcaccuccgggagaagcugcugaaggacaacaagaucgacgugauccucaccaacuucauggagauccgcgagaagaucaagagcaaccuggagaucaugggguucgucaaguucuaccugaacguguccggcgacaagaagaaguccgagaacaagaagauguucguggagaagauccucaacaccaacgucgaccugaccguggaggacaucguggacuucaucgucaaggagcugaaguucuggaacaucacgaagcggaucgagaaggugaagaaguucaacaacgaguuccucgagaaccgccggaaccgcaccuacaucaagagcuacgugcugcuggacaagcacgagaaguucaagaucgagcgggagaacaagaaggacaagaucgucaaguucuucguggagaacaucaagaacaacagcaucaaggagaagaucgagaagauccucgccgaguucaagaucaacgagcugaucaagaagcuggagaaggagcucaagaaggggaacugcgacaccgagaucuucggcaucuucaagaagcacuacaaggugaacuucgacuccaagaaguucagcaacaaguccgacgaggagaaggagcuguacaagaucaucuaccgcuaccugaaggggcggaucgagaagauccucgucaacgagcagaaggugcgccugaagaagauggagaagaucgagaucgagaagauccugaacgagagcauccucuccgagaagauccugaagcgggugaagcaguacacccuggagcacaucauguaccucggcaagcugcgccacaacgacaucgucaagaugacggugaacaccgacgacuucagccgccugcacgccaaggaggagcucgaccuggagcugaucaccuucuucgccuccaccaacauggagcucaacaagaucuucaacggcaaggagaaggucacggacuucuucggguucaaccugaacggccagaagaucacccugaaggagaaggugcccagcuucaagcucaacauccugaagaagcugaacuucaucaacaacgagaacaacaucgacgagaagcucucccacuucuacagcuuccagaaggagggguaccugcugcggaacaagauccugcacaacuccuacggcaacauccaggagaccaagaaccucaagggcgaguacgagaacguggagaagcugaucaaggagcugaaggucagcgacgaggagaucagcaagucccucagccuggacgugaucuucgaggggaagguggacaucaucaacaagaucaacucccugaagaucggcgaguacaaggacaagaaguaccucccgagcuucuccaagaucguccuggagaucacccgcaaguuccgggagaucaacaaggacaagcuguucgacaucgagagcgagaagaucauccucaacgccgugaaguacgugaacaagauccuguacgagaagaucacguccaacgaggagaacgaguuccugaagacccuccccgacaagcuggucaagaaguccaacaacaagaaggagaacaagaaccugcucagcaucgaggaguacuacaagaacgcccaggugagcuccagcaagggggacaagaaggcgaucaagaaguaccagaacaaggugaccaacgccuaccuggaguaccuggagaacaccuucacggagaucaucgacuucuccaaguucaaccucaacuacgacgagaucaagaccaagaucgaggagcgcaaggacaacaagagcaagaucaucaucgacuccaucagcaccaacaucaacaucaccaacgacaucgaguacaucaucuccaucuucgcccugcugaacagcaacacguacaucaacaagauccggaaccgcuucuucgcgaccuccgucuggcucgagaagcagaacggcaccaaggaguacgacuacgagaacaucaucagcauccuggacgaggugcugcucaucaaccugcugcgggagaacaacaucaccgacauccucgaccugaagaacgccaucaucgacgccaagaucguggagaacgacgagacguacaucaagaacuacaucuucgagagcaacgaggagaagcugaagaagcgccucuucugcgaggagcuggucgacaaggaggacauccggaagaucuucgaggacgagaacuucaaguucaaguccuucaucaagaagaacgagaucgggaacuucaagaucaacuucggcauccugagcaaccucgagugcaacuccgagguggaggccaagaagaucaucggcaagaacagcaagaagcuggaguccuucauccagaacaucaucgacgaguacaagagcaacauccgcacccuguucuccagcgaguuccucgagaaguacaaggaggagaucgacaaccugguggaggacaccgaguccgagaacaagaacaaguucgagaagaucuacuaccccaaggagcacaagaacgagcuguacaucuacaagaagaaccucuuccugaacaucgggaaccccaacuucgacaagaucuacggccugaucagcaaggacaucaagaacgucgacaccaagauccucuucgacgacgacaucaagaagaacaagaucuccgagaucgacgccauccugaagaaccugaacgacaagcucaacggguacagcaacgacuacaaggcgaaguacgugaacaagcugaaggagaacgacgacuucuucgccaagaacauccagaacgagaacuacuccagcuucggcgaguucgagaaggacuacaacaagguguccgaguacaagaagauccgggaccuggucgaguucaacuaccucaacaagaucgagagcuaccugaucgacaucaacuggaagcuggccauccagauggcccgcuucgagcgggacaugcacuacaucgugaacgggcuccgcgagcugggcaucaucaagcuguccggcuacaacacggggaucagccgggccuacccgaagcgcaacggcagcgacggguucuacaccaccaccgcguacuacaaguucuucgacgaggaguccuacaagaaguucgagaagaucugcuacggcuucgggaucgaccucagcgagaacuccgagaucaacaagcccgagaacgagagcauccggaacuacaucucccacuucuacaucgugcgcaaccccuucgccgacuacagcaucgccgagcagaucgaccgggucuccaaccugcugagcuacuccacccgcuacaacaacagcacguacgccuccguguucgagguguucaagaaggacgucaaccucgacuacgacgagcugaagaagaaguuccgccugaucggcaacaacgacauccucgagcggcugaugaagcccaagaaggugagcgugcuggagcucgaguccuacaacagcgacuacaucaagaaccugaucaucgagcugcucaccaagaucgagaacaccaacgacacccuguga

SEQ ID NO: 11149 - RNA, 3459 nt, Artificial Sequence
  Cas13a variant__Leptotrichia wadei__WP_021746774.1__Cas13a
augaaggugaccaaggucgacggcaucagccacaagaaguacaucgaggaggggaagcuggugaaguccaccagcgaggagaaccgcacguccgagcggcucagcgagcugcuguccauccgccucgacaucuacaucaagaaccccgacaacgccagcgaggaggagaaccggauccgccgggagaaccugaagaaguucuucuccaacaaggugcugcaccucaaggacagcguccuguaccugaagaaccgcaaggagaagaacgccgugcaggacaagaacuacuccgaggaggacaucagcgaguacgaccucaagaacaagaacuccuucagcgugcugaagaagauccugcucaacgaggacgucaacuccgaggagcuggagaucuuccggaaggacguggaggcgaagcugaacaagaucaacagccucaaguacuccuucgaggagaacaaggccaacuaccagaagaucaacgagaacaacguggagaaggucggcggcaagagcaagcgcaacaucaucuacgacuacuaccgggaguccgccaagcgcaacgacuacaucaacaacgugcaggaggccuucgacaagcuguacaagaaggaggacaucgagaagcuguucuuccucaucgagaacagcaagaagcacgagaaguacaagauccgggaguacuaccacaagaucaucgggcgcaagaacgacaaggagaacuucgccaagaucaucuacgaggagauccagaacgugaacaacaucaaggagcugaucgagaagaucccggacauguccgagcugaagaagucccaggucuucuacaaguacuaccucgacaaggaggagcugaacgacaagaacaucaaguacgcguucugccacuucguggagaucgagaugagccagcugcucaagaacuacguguacaagcggcugagcaacaucagcaacgacaagaucaagcgcaucuucgaguaccagaaccugaagaagcucaucgagaacaagcugcugaacaagcucgacaccuacguccggaacugcgggaaguacaacuacuaccuccaggugggcgagaucgccaccuccgacuucaucgcccgcaaccggcagaacgaggccuuccugcgcaacaucaucggcgugagcuccgucgcguacuucagccugcggaacauccuggagaccgagaacgagaacgggaucacgggccgcaugcgggggaagaccgugaagaacaacaagggcgaggagaaguacguguccggggaggucgacaagaucuacaacgagaacaagcagaacgaggugaaggagaaccugaagauguucuacagcuacgacuucaacauggacaacaagaacgagaucgaggacuucuucgccaacaucgacgaggccaucuccagcauccgccacggcaucgugcacuucaaccucgagcuggagggcaaggacaucuucgccuucaagaacaucgcccccuccgagaucagcaagaagauguuccagaacgagaucaacgagaagaagcugaagcucaagaucuucaagcagcugaacuccgcgaacgucuucaacuacuacgagaaggacgugaucaucaaguaccugaagaacaccaaguucaacuucgucaacaagaacauccccuucgugcccagcuucaccaagcucuacaacaagaucgaggaccugcgcaacacgcugaaguucuucugguccgugccgaaggacaaggaggagaaggacgcccagaucuaccuccugaagaacaucuacuacggggaguuccugaacaaguucgucaagaacagcaagguguucuucaagaucaccaacgaggugaucaagaucaacaagcagcggaaccagaagaccggccacuacaaguaccagaaguucgagaacaucgagaagaccguccccguggaguaccucgccaucauccagucccgcgagaugaucaacaaccaggacaaggaggagaagaacacguacaucgacuucauccagcagaucuuccugaagggguucaucgacuaccugaacaagaacaaccugaaguacaucgagagcaacaacaacaacgacaacaacgacaucuucuccaagaucaagaucaagaaggacaacaaggagaaguacgacaagauccucaagaacuacgagaagcacaaccggaacaaggagaucccccacgagaucaacgaguucgugcgcgagaucaagcugggcaagauccugaaguacaccgagaaccucaacauguucuaccugauccugaagcuccugaaccacaaggagcugaccaaccucaagggcagccuggagaaguaccagagcgccaacaaggaggagaccuucuccgacgagcuggagcucaucaaccugcugaaccucgacaacaaccgggucacggaggacuucgagcuggaggccaacgagaucgggaaguuccuggacuucaacgagaacaagaucaaggaccgcaaggagcucaagaaguucgacaccaacaagaucuacuucgacggcgagaacaucaucaagcaccgggcguucuacaacaucaagaaguacgggaugcugaaccugcucgagaagaucgccgacaaggccaaguacaagaucagccugaaggagcugaaggaguacuccaacaagaagaacgagaucgagaagaacuacaccaugcagcagaaccuccaccgcaaguacgcccggcccaagaaggacgagaaguucaacgacgaggacuacaaggaguacgagaaggccaucggcaacauccagaaguacacccaccugaagaacaagguggaguucaacgagcugaaccuccugcaggggcugcuccugaagauccugcaccgccucgugggcuacacgagcaucugggagcgggaccugcgcuuccggcugaagggcgaguucccggagaaccacuacaucgaggagaucuucaacuucgacaacuccaagaacgucaaguacaagagcgggcagaucguggagaaguacaucaacuucuacaaggagcucuacaaggacaacguggagaagcgcuccaucuacagcgacaagaaggucaagaagcugaagcaggagaagaaggaccuguacauccggaacuacaucgcgcacuucaacuacaucccccacgccgagaucucccuccuggaggugcuggagaaccuccgcaagcugcugagcuacgaccggaagcucaagaacgccaucaugaaguccaucguggacauccugaaggaguacggcuucgucgccaccuucaagaucggggccgacaagaagaucgagauccagacccuggagagcgagaagaucgugcaccucaagaaccugaagaagaagaagcugaugaccgaccgcaacuccgaggagcucugcgagcuggugaaggucauguucgaguacaaggcgcuggaguga

SEQ ID NO: 11150 - RNA, 3459 nt, Artificial Sequence
  Cas13a variant__Leptotrichia wadei__WP_021746774.1__Cas13a(G403D)
augaaggugaccaaggucgacggcaucagccacaagaaguacaucgaggaggggaagcuggugaaguccaccagcgaggagaaccgcacguccgagcggcucagcgagcugcuguccauccgccucgacaucuacaucaagaaccccgacaacgccagcgaggaggagaaccggauccgccgggagaaccugaagaaguucuucuccaacaaggugcugcaccucaaggacagcguccuguaccugaagaaccgcaaggagaagaacgccgugcaggacaagaacuacuccgaggaggacaucagcgaguacgaccucaagaacaagaacuccuucagcgugcugaagaagauccugcucaacgaggacgucaacuccgaggagcuggagaucuuccggaaggacguggaggcgaagcugaacaagaucaacagccucaaguacuccuucgaggagaacaaggccaacuaccagaagaucaacgagaacaacguggagaaggucggcggcaagagcaagcgcaacaucaucuacgacuacuaccgggaguccgccaagcgcaacgacuacaucaacaacgugcaggaggccuucgacaagcuguacaagaaggaggacaucgagaagcuguucuuccucaucgagaacagcaagaagcacgagaaguacaagauccgggaguacuaccacaagaucaucgggcgcaagaacgacaaggagaacuucgccaagaucaucuacgaggagauccagaacgugaacaacaucaaggagcugaucgagaagaucccggacauguccgagcugaagaagucccaggucuucuacaaguacuaccucgacaaggaggagcugaacgacaagaacaucaaguacgcguucugccacuucguggagaucgagaugagccagcugcucaagaacuacguguacaagcggcugagcaacaucagcaacgacaagaucaagcgcaucuucgaguaccagaaccugaagaagcucaucgagaacaagcugcugaacaagcucgacaccuacguccggaacugcgggaaguacaacuacuaccuccaggugggcgagaucgccaccuccgacuucaucgcccgcaaccggcagaacgaggccuuccugcgcaacaucaucggcgugagcuccgucgcguacuucagccugcggaacauccuggagaccgagaacgagaacgacaucacggggcgcaugcggggcaagaccgugaagaacaacaagggggaggagaaguacguguccggcgaggucgacaagaucuacaacgagaacaagcagaacgaggugaaggagaaccugaagauguucuacagcuacgacuucaacauggacaacaagaacgagaucgaggacuucuucgccaacaucgacgaggccaucuccagcauccgccacgggaucgugcacuucaaccucgagcuggagggcaaggacaucuucgccuucaagaacaucgcccccuccgagaucagcaagaagauguuccagaacgagaucaacgagaagaagcugaagcucaagaucuucaagcagcugaacuccgcgaacgucuucaacuacuacgagaaggacgugaucaucaaguaccugaagaacaccaaguucaacuucgucaacaagaacauccccuucgugcccagcuucaccaagcucuacaacaagaucgaggaccugcgcaacacgcugaaguucuucugguccgugccgaaggacaaggaggagaaggacgcccagaucuaccuccugaagaacaucuacuacggcgaguuccugaacaaguucgucaagaacagcaagguguucuucaagaucaccaacgaggugaucaagaucaacaagcagcggaaccagaagaccgggcacuacaaguaccagaaguucgagaacaucgagaagaccguccccguggaguaccucgccaucauccagucccgcgagaugaucaacaaccaggacaaggaggagaagaacacguacaucgacuucauccagcagaucuuccugaagggcuucaucgacuaccugaacaagaacaaccugaaguacaucgagagcaacaacaacaacgacaacaacgacaucuucuccaagaucaagaucaagaaggacaacaaggagaaguacgacaagauccucaagaacuacgagaagcacaaccggaacaaggagaucccccacgagaucaacgaguucgugcgcgagaucaagcuggggaagauccugaaguacaccgagaaccucaacauguucuaccugauccugaagcuccugaaccacaaggagcugaccaaccucaagggcagccuggagaaguaccagagcgccaacaaggaggagaccuucuccgacgagcuggagcucaucaaccugcugaaccucgacaacaaccgggucacggaggacuucgagcuggaggccaacgagaucggcaaguuccuggacuucaacgagaacaagaucaaggaccgcaaggagcucaagaaguucgacaccaacaagaucuacuucgacggggagaacaucaucaagcaccgggcguucuacaacaucaagaaguacggcaugcugaaccugcucgagaagaucgccgacaaggccaaguacaagaucagccugaaggagcugaaggaguacuccaacaagaagaacgagaucgagaagaacuacaccaugcagcagaaccuccaccgcaaguacgcccggcccaagaaggacgagaaguucaacgacgaggacuacaaggaguacgagaaggccaucgggaacauccagaaguacacccaccugaagaacaagguggaguucaacgagcugaaccuccugcagggccugcuccugaagauccugcaccgccucgugggguacacgagcaucugggagcgggaccugcgcuuccggcugaagggcgaguucccggagaaccacuacaucgaggagaucuucaacuucgacaacuccaagaacgucaaguacaagagcggccagaucguggagaaguacaucaacuucuacaaggagcucuacaaggacaacguggagaagcgcuccaucuacagcgacaagaaggucaagaagcugaagcaggagaagaaggaccuguacauccggaacuacaucgcgcacuucaacuacaucccccacgccgagaucucccuccuggaggugcuggagaaccuccgcaagcugcugagcuacgaccggaagcucaagaacgccaucaugaaguccaucguggacauccugaaggaguacggguucgucgccaccuucaagaucggcgccgacaagaagaucgagauccagacccuggagagcgagaagaucgugcaccucaagaaccugaagaagaagaagcugaugaccgaccgcaacuccgaggagcucugcgagcuggugaaggucauguucgaguacaaggcgcuggaguga

SEQ ID NO: 11151 - RNA, 3909 nt, Artificial Sequence
  Cas13a variant__Leptotrichia wadei__WP_021746774.1__6xHis-Tag/Twin-Strep/SUMO_Cas13a(G403D)
augggcagcucccaccaccaccaccaccacagcuccgggcuggugccccgcggcagccacauggccuccuggagccacccgcaguucgagaagggcggcggguccgggggcgggagcggcggguccgccuggagccacccccaguucgagaagauguccgacagcgaggucaaccaggaggcgaagcccgaggugaagcccgaggugaagccggagacccacaucaaccucaaggucuccgacggcagcuccgagaucuucuucaagaucaagaagaccacgccccugcggcgccugauggaggccuucgccaagcggcaggggaaggagauggacagccuccgcuuccuguacgacggcauccggauccaggccgaccagacccccgaggaccuggacauggaggacaacgacaucaucgaggcccaccgcgagcagaucggcggguccaugaaggugaccaagguggacggcaucagccacaagaaguacaucgaggaggggaagcucgucaaguccaccagcgaggagaaccggacgagcgagcgccuguccgagcugcucagcauccggcuggacaucuacaucaagaaccccgacaacgcguccgaggaggagaaccgcauccggcgcgagaaccugaagaaguucuucagcaacaaggugcuccaccugaaggacuccgugcuguaccucaagaaccggaaggagaagaacgccguccaggacaagaacuacagcgaggaggacaucuccgaguacgaccugaagaacaagaacagcuucuccgugcugaagaagauccuccugaacgaggacgugaacagcgaggagcuggagaucuuccgcaaggacgucgaggccaagcucaacaagaucaacucccugaaguacagcuucgaggagaacaaggccaacuaccagaagaucaacgagaacaacguggagaaggugggcggcaaguccaagcggaacaucaucuacgacuacuaccgcgagagcgcgaagcggaacgacuacaucaacaacguccaggaggccuucgacaagcuguacaagaaggaggacaucgagaagcuguucuuccucaucgagaacuccaagaagcacgagaaguacaagauccgcgaguacuaccacaagaucaucgggcggaagaacgacaaggagaacuucgccaagaucaucuacgaggagauccagaacgugaacaacaucaaggagcugaucgagaagaucccggacaugagcgagcucaagaagucccagguguucuacaaguacuaccuggacaaggaggagcugaacgacaagaacaucaaguacgccuucugccacuucgucgagaucgagaugagccagcuccugaagaacuacguguacaagcgccuguccaacaucagcaacgacaagaucaagcggaucuucgaguaccagaaccucaagaagcugaucgagaacaagcugcucaacaagcuggacaccuacgugcgcaacugcggcaaguacaacuacuaccugcaggucggggagaucgccaccagcgacuucaucgcgcgcaaccggcagaacgaggccuuccuccgcaacaucaucggcguguccagcguggccuacuucucccugcggaacauccuggagaccgagaacgagaacgacaucacggggcgcaugcggggcaagaccgucaagaacaacaagggcgaggagaaguacgugagcggggaggucgacaagaucuacaacgagaacaagcagaacgaggugaaggagaaccucaagauguucuacuccuacgacuucaacauggacaacaagaacgagaucgaggacuucuucgccaacaucgacgaggccaucagcuccauccgccacggcaucgugcacuucaaccuggagcuggaggggaaggacaucuucgcguucaagaacaucgcccccagcgagaucuccaagaagauguuccagaacgagaucaacgagaagaagcucaagcugaagaucuucaagcagcugaacagcgccaacgucuucaacuacuacgagaaggacgugaucaucaaguaccucaagaacaccaaguucaacuucgugaacaagaacauccccuucguccccuccuucaccaagcuguacaacaagaucgaggaccugcggaacacgcugaaguucuucuggagcgugccgaaggacaaggaggagaaggacgcccagaucuaccuccugaagaacaucuacuacggcgaguuccugaacaaguucgugaagaacuccaaggucuucuucaagaucaccaacgaggugaucaagaucaacaagcagcgcaaccagaagaccgggcacuacaaguaccagaaguucgagaacaucgagaagaccgugcccgucgaguaccucgccaucauccagagccgggagaugaucaacaaccaggacaaggaggagaagaacacguacaucgacuucauccagcagaucuuccugaagggcuucaucgacuaccugaacaagaacaaccucaaguacaucgaguccaacaacaacaacgacaacaacgacaucuucagcaagaucaagaucaagaaggacaacaaggagaaguacgacaagauccugaagaacuacgagaagcacaaccgcaacaaggagaucccccacgagaucaacgaguucgugcgggagaucaagcugggcaagauccucaaguacaccgagaaccugaacauguucuaccugauccucaagcugcugaaccacaaggagcucaccaaccugaaggggucccuggagaaguaccagagcgcgaacaaggaggagaccuucagcgacgagcucgagcugaucaaccugcucaaccuggacaacaaccgcgugacggaggacuucgagcuggaggccaacgagaucggcaaguuccucgacuucaacgagaacaagaucaaggaccggaaggagcugaagaaguucgacaccaacaagaucuacuucgacggggagaacaucaucaagcaccgcgccuucuacaacaucaagaaguacggcaugcugaaccuccuggagaagaucgccgacaaggccaaguacaagaucucccugaaggagcucaaggaguacagcaacaagaagaacgagaucgagaagaacuacaccaugcagcagaaccugcaccggaaguacgcgcgccccaagaaggacgagaaguucaacgacgaggacuacaaggaguacgagaaggccaucgggaacauccagaaguacacccaccugaagaacaaggucgaguucaacgagcucaaccugcugcagggccuccugcugaagauccuccaccggcuggugggcuacacguccaucugggagcgcgaccugcgguuccgccucaagggggaguucccggagaaccacuacaucgaggagaucuucaacuucgacaacagcaagaacgugaaguacaaguccggccagaucgucgagaaguacaucaacuucuacaaggagcuguacaaggacaacguggagaagcgcagcaucuacuccgacaagaaggugaagaagcugaagcaggagaagaaggaccucuacauccggaacuacaucgcccacuucaacuacaucccccacgccgagaucagccugcuggagguccucgagaaccugcgcaagcugcucuccuacgaccggaagcugaagaacgcgaucaugaaguccaucguggacauccugaaggaguacggguucguggccaccuucaagaucggcgccgacaagaagaucgagauccagacccucgagagcgagaagaucguccaccugaagaaccugaagaagaagaagcucaugaccgaccgcaacagcgaggagcugugcgagcuggugaaggugauguucgaguacaaggcccucgaguga

SEQ ID NO: 11152 - RNA, 3459 nt, Artificial Sequence
  Cas13a variant__Leptotrichia wadei__WP_021746774.1__Cas13a(R474A,R1046A)
augaaggugaccaaggucgacggcaucagccacaagaaguacaucgaggaggggaagcuggugaaguccaccagcgaggagaaccgcacguccgagcggcucagcgagcugcuguccauccgccucgacaucuacaucaagaaccccgacaacgccagcgaggaggagaaccggauccgccgggagaaccugaagaaguucuucuccaacaaggugcugcaccucaaggacagcguccuguaccugaagaaccgcaaggagaagaacgccgugcaggacaagaacuacuccgaggaggacaucagcgaguacgaccucaagaacaagaacuccuucagcgugcugaagaagauccugcucaacgaggacgucaacuccgaggagcuggagaucuuccggaaggacguggaggcgaagcugaacaagaucaacagccucaaguacuccuucgaggagaacaaggccaacuaccagaagaucaacgagaacaacguggagaaggucggcggcaagagcaagcgcaacaucaucuacgacuacuaccgggaguccgccaagcgcaacgacuacaucaacaacgugcaggaggccuucgacaagcuguacaagaaggaggacaucgagaagcuguucuuccucaucgagaacagcaagaagcacgagaaguacaagauccgggaguacuaccacaagaucaucgggcgcaagaacgacaaggagaacuucgccaagaucaucuacgaggagauccagaacgugaacaacaucaaggagcugaucgagaagaucccggacauguccgagcugaagaagucccaggucuucuacaaguacuaccucgacaaggaggagcugaacgacaagaacaucaaguacgcguucugccacuucguggagaucgagaugagccagcugcucaagaacuacguguacaagcggcugagcaacaucagcaacgacaagaucaagcgcaucuucgaguaccagaaccugaagaagcucaucgagaacaagcugcugaacaagcucgacaccuacguccggaacugcgggaaguacaacuacuaccuccaggugggcgagaucgccaccuccgacuucaucgcccgcaaccggcagaacgaggccuuccugcgcaacaucaucggcgugagcuccgucgcguacuucagccugcggaacauccuggagaccgagaacgagaacgggaucacgggccgcaugcgggggaagaccgugaagaacaacaagggcgaggagaaguacguguccggggaggucgacaagaucuacaacgagaacaagcagaacgaggugaaggagaaccugaagauguucuacagcuacgacuucaacauggacaacaagaacgagaucgaggacuucuucgccaacaucgacgaggccaucuccagcaucgcccacggcaucgugcacuucaaccucgagcuggagggcaaggacaucuucgccuucaagaacaucgcgcccuccgagaucagcaagaagauguuccagaacgagaucaacgagaagaagcugaagcucaagaucuucaagcagcugaacuccgccaacgucuucaacuacuacgagaaggacgugaucaucaaguaccugaagaacaccaaguucaacuucgucaacaagaacauccccuucgugcccagcuucaccaagcucuacaacaagaucgaggaccugcgcaacacgcugaaguucuucugguccgugccgaaggacaaggaggagaaggacgcccagaucuaccuccugaagaacaucuacuacggggaguuccugaacaaguucgucaagaacagcaagguguucuucaagaucaccaacgaggugaucaagaucaacaagcagcgcaaccagaagaccggccacuacaaguaccagaaguucgagaacaucgagaagaccguccccguggaguaccucgccaucauccagucccgggagaugaucaacaaccaggacaaggaggagaagaacacguacaucgacuucauccagcagaucuuccugaagggguucaucgacuaccugaacaagaacaaccugaaguacaucgagagcaacaacaacaacgacaacaacgacaucuucuccaagaucaagaucaagaaggacaacaaggagaaguacgacaagauccucaagaacuacgagaagcacaaccgcaacaaggagaucccccacgagaucaacgaguucgugcgggagaucaagcugggcaagauccugaaguacaccgagaaccucaacauguucuaccugauccugaagcuccugaaccacaaggagcugaccaaccucaagggcagccuggagaaguaccagagcgccaacaaggaggagaccuucuccgacgagcuggagcucaucaaccugcugaaccucgacaacaaccgcgucacggaggacuucgagcuggaggcgaacgagaucgggaaguuccuggacuucaacgagaacaagaucaaggaccggaaggagcucaagaaguucgacaccaacaagaucuacuucgacggcgagaacaucaucaagcaccgcgccuucuacaacaucaagaaguacgggaugcugaaccugcucgagaagaucgccgacaaggccaaguacaagaucagccugaaggagcugaaggaguacuccaacaagaagaacgagaucgagaagaacuacaccaugcagcagaaccuccaccggaaguacgcccgccccaagaaggacgagaaguucaacgacgaggacuacaaggaguacgagaaggcgaucggcaacauccagaaguacacccaccugaagaacaagguggaguucaacgagcugaaccuccugcaggggcugcuccugaagauccugcaccggcucgugggcuacacgagcaucugggagcgcgaccugcgguuccgccugaagggcgaguucccggagaaccacuacaucgaggagaucuucaacuucgacaacuccaagaacgucaaguacaagagcgggcagaucguggagaaguacaucaacuucuacaaggagcucuacaaggacaacguggagaagcgguccaucuacagcgacaagaaggucaagaagcugaagcaggagaagaaggaccuguacaucgccaacuacaucgcccacuucaacuacaucccccacgccgagaucucccuccuggaggugcuggagaaccuccgcaagcugcugagcuacgaccggaagcucaagaacgccaucaugaaguccaucguggacauccugaaggaguacggcuucgucgcgaccuucaagaucggggccgacaagaagaucgagauccagacccuggagagcgagaagaucgugcaccucaagaaccugaagaagaagaagcugaugaccgaccgcaacuccgaggagcucugcgagcuggugaaggucauguucgaguacaaggcccuggaguga

SEQ ID NO: 11153 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggcggggagggccugcgcgccagcccccggcgccggccgcuccugccccugcagccccgcgggugcccccggggcgacgggugccuccgcggcggccgggggcgcgccggcuucggguucuggcgggugaccggcgggucccgcgcgagcgccaaccacguccacgccuucuucuucuuccugcagcugcucggcaacgugcuggugaucguccugucccaccacuucggcaaggaguucgggaccgccggcccgggggccacgaugaaggugaccaagguggacggcaucagccacaagaaguacaucgaggagggcaagcucgucaaguccaccagcgaggagaaccggaccuccgagcgccugagcgagcugcucuccauccggcuggacaucuacaucaagaaccccgacaacgcgagcgaggaggagaaccgcauccggcgcgagaaccugaagaaguucuucuccaacaaggugcuccaccugaaggacagcgugcuguaccucaagaaccggaaggagaagaacgccguccaggacaagaacuacuccgaggaggacaucagcgaguacgaccugaagaacaagaacuccuucagcgugcugaagaagauccuccugaacgaggacgugaacuccgaggagcuggagaucuuccgcaaggacgucgaggccaagcucaacaagaucaacagccugaaguacuccuucgaggagaacaaggccaacuaccagaagaucaacgagaacaacguggagaaggucgggggcaagagcaagcggaacaucaucuacgacuacuaccgcgagagcgcgaagcggaacgacuacaucaacaacgugcaggaggccuucgacaagcuguacaagaaggaggacaucgagaagcuguucuuccugaucgagaacuccaagaagcacgagaaguacaagauccgcgaguacuaccacaagaucaucgggcgcaagaacgacaaggagaacuucgccaagaucaucuacgaggagauccagaacgugaacaacaucaaggagcugaucgagaagauccccgacaugagcgagcucaagaagucccagguguucuacaaguacuaccuggacaaggaggagcugaacgacaagaacaucaaguacgccuucugccacuucgucgagaucgagaugagccagcuccugaagaacuacguguacaagcggcuguccaacaucagcaacgacaagaucaagcgcaucuucgaguaccagaaccucaagaagcugaucgagaacaagcugcucaacaagcuggacacguacgugcggaacugcggcaaguacaacuacuaccugcaggucggggagaucgccaccuccgacuucaucgcgcgcaaccggcagaacgaggccuuccuccgcaacaucaucggcgugagcuccguggccuacuucagccugcggaacauccuggagaccgagaacgagaacggcaucaccgggcgcaugcggggcaagacggucaagaacaacaagggggaggagaaguacguguccggcgaggucgacaagaucuacaacgagaacaagcagaacgaggugaaggagaaccucaagauguucuacagcuacgacuucaacauggacaacaagaacgagaucgaggacuucuucgccaacaucgacgaggccaucuccagcaucgcgcacgggaucgugcacuucaaccuggagcuggagggcaaggacaucuucgccuucaagaacaucgcccccuccgagaucagcaagaagauguuccagaacgagaucaacgagaagaagcucaagcugaagaucuucaagcagcugaacuccgccaacgucuucaacuacuacgagaaggacgugaucaucaaguaccugaagaacaccaaguucaacuucgugaacaagaacaucccguucguccccagcuucaccaagcucuacaacaagaucgaggaccugcgcaacacccugaaguucuucugguccgugcccaaggacaaggaggagaaggacgcccagaucuaccuccugaagaacaucuacuacggcgaguuccugaacaaguucgugaagaacagcaaggucuucuucaagaucacgaacgaggugaucaagaucaacaagcagcggaaccagaagaccgggcacuacaaguaccagaaguucgagaacaucgagaagaccgugcccgucgaguaccucgcgaucauccagagccgcgagaugaucaacaaccaggacaaggaggagaagaacaccuacaucgacuucauccagcagaucuuccugaagggcuucaucgacuaccugaacaagaacaaccucaaguacaucgaguccaacaacaacaacgacaacaacgacaucuucagcaagaucaagaucaagaaggacaacaaggagaaguacgacaagauccugaagaacuacgagaagcacaaccggaacaaggagaucccgcacgagaucaacgaguucgugcgcgagaucaagcuggggaagauccucaaguacacggagaaccugaacauguucuaccugauccucaagcugcugaaccacaaggagcucaccaaccugaagggcucccuggagaaguaccagagcgccaacaaggaggagaccuucuccgacgagcucgagcugaucaaccugcucaaccuggacaacaaccgggugaccgaggacuucgagcuggaggccaacgagaucgggaaguuccucgacuucaacgagaacaagaucaaggaccgcaaggagcugaagaaguucgacacgaacaagaucuacuucgacggcgagaacaucaucaagcaccgggccuucuacaacaucaagaaguacggcaugcugaaccuccuggagaagaucgccgacaaggcgaaguacaagaucagccugaaggagcucaaggaguacuccaacaagaagaacgagaucgagaagaacuacaccaugcagcagaaccugcaccgcaaguacgcccggcccaagaaggacgagaaguucaacgacgaggacuacaaggaguacgagaaggccaucgggaacauccagaaguacacccaccugaagaacaaggucgaguucaacgagcucaaccugcugcagggccuccugcugaagauccuccaccgccuggugggguacaccagcaucugggagcgcgaccugcgguuccgccucaagggcgaguuccccgagaaccacuacaucgaggagaucuucaacuucgacaacuccaagaacgugaaguacaagagcggccagaucgucgagaaguacaucaacuucuacaaggagcuguacaaggacaacguggagaagcgguccaucuacagcgacaagaaggugaagaagcugaagcaggagaagaaggaccucuacaucgccaacuacaucgcgcacuucaacuacaucccccacgccgagaucucccugcuggagguccucgagaaccugcgcaagcugcucagcuacgaccggaagcugaagaacgccaucaugaaguccaucguggacauccugaaggaguacggguucguggccacguucaagaucggcgccgacaagaagaucgagauccagacccucgagagcgagaagaucguccaccugaagaaccugaagaagaagaagcucaugaccgaccgcaacuccgaggagcugugcgagcuggugaaggugauguucgaguacaaggcgcucgagggcgggggcgggagcggcgggggcgggagcggcgggggcggcuccgucagcaagggggaggagcuguucaccggcguggugccgauccuggucgagcucgacggggacgugaacggccacaaguucuccgugagcggggagggcgagggcgacgccacguacgggaagcugacccugaaguucaucugcaccaccggcaagcuccccguccccuggcccacgcuggugaccacccugaccuacggggugcagugcuucucccgguacccggaccacaugaagcagcacgacuucuucaagagcgccaugcccgagggcuacguccaggagcgcacgaucuucuucaaggacgacgggaacuacaagacccgggccgaggugaaguucgagggcgacacccucgugaaccgcaucgagcugaagggcaucgacuucaaggaggacgggaacauccugggccacaagcucgaguacaacuacaacucccacaacgucuacaucauggccgacaagcagaagaacgggaucaaggugaacuucaagauccggcacaacaucgaggacggcagcgugcagcuggcggaccacuaccagcagaacacccccaucggcgacgggcccguccugcucccggacaaccacuaccuguccacccagagcgcccuguccaaggaccccaacgagaagcgcgaccacauggugcuccuggaguucgugacggccgccggcaucacccuggggauggacgagcucuacagccggggcgccggggcgggcgccggcgccggggccggcucccgcuuccagugccggaucugcaugcgcaacuucagcgaccgguccaaccugagccgccacauccggacccacaccggggagaagcccuucgcgugcgacaucugcggccgcaaguucgccaucuccagcaaccugaacucccacacgaagauccacaccgggagccagaagcccuuccagugccggaucugcaugcgcaacuucagccgcuccgacaaccucgcccggcacauccgcacccacaccggcgagaagccguucgccugcgacaucugcggccggaaguucgccacgagcgggaaccugacccgccacaccaagauccaccuccggggcucccagcucagcaucgucgacgcgcccgagcagcgcgagggggccucccaggugagcguguccgucaccuucgaggacguggccgugcuguucacgcgggacgaguggaagaagcuggaccucagccagcgcucccuguaccgggaggucaugcuggagaacuacagcaaccuggccuccauggccggcagccccaagaagaagcgcaagguguga

SEQ ID NO: 11154 - RNA, 3549 nt, Artificial Sequence
  Cas13a variant__Leptotrichia wadei__ERK53440.1__Cas13a
auguacaugaagaucaccaagaucgacggcgugagccacuacaagaagcaggacaaggggauccugaagaagaaguggaaggaccucgacgagcgcaagcagcgggagaagaucgaggcccgcuacaacaagcagaucgaguccaagaucuacaaggaguucuuccggcugaagaacaagaagcgcaucgagaaggaggaggaccagaacaucaagagccuguacuucuucaucaaggagcucuaccugaacgagaagaacgaggagugggagcugaagaacaucaaccucgagauccuggacgacaaggagcgggucaucaagggcuacaaguucaaggaggacguguacuucuucaaggagggguacaaggaguacuaccugcgcauccucuucaacaaccugaucgagaaggugcagaacgagaaccgggagaagguccgcaagaacaaggaguuccuggaccucaaggagaucuucaagaaguacaagaaccggaagaucgaccugcugcucaaguccaucaacaacaacaagaucaaccuggaguacaagaaggagaacgugaacgaggagaucuacggcaucaaccccaccaacgaccgcgagaugacguucuacgagcugcucaaggagaucaucgagaagaaggacgagcagaaguccauccuggaggagaagcuggacaacuucgacaucaccaacuuccucgagaacaucgagaagaucuucaacgaggagaccgagaucaacaucaucaaggggaaggugcugaacgagcugcgggaguacaucaaggagaaggaggagaacaacagcgacaacaagcucaagcagaucuacaaccuggagcugaagaaguacaucgagaacaacuucagcuacaagaagcagaaguccaagagcaagaacggcaagaacgacuaccucuaccugaacuuccugaagaagaucauguucaucgaggaggucgacgagaagaaggagaucaacaaggagaaguucaagaacaagaucaacuccaacuucaagaaccucuucgugcagcacauccuggacuacggcaagcugcucuacuacaaggagaacgacgaguacaucaagaacaccgggcagcuggagacgaaggaccuggaguacaucaagaccaaggagacccucauccgcaagauggccgugcuggucagcuucgcggccaacuccuacuacaaccuguucggccgggugagcggggacauccucggcaccgagguggucaaguccagcaagacgaacgugaucaagguggggucccacaucuucaaggagaagaugcugaacuacuucuucgacuucgagaucuucgacgccaacaagaucgucgagauccuggagagcaucuccuacagcaucuacaacgugcgcaacggcgugggccacuucaacaagcucauccuggggaaguacaagaagaaggacaucaacaccaacaagcggaucgaggaggaccugaacaacaacgaggagaucaagggcuacuucaucaagaagcgcggggagaucgagcggaaggucaaggagaaguuccucuccaacaaccugcaguacuacuacagcaaggagaagaucgagaacuacuucgagguguacgaguucgagauccugaagcgcaagaucccguucgcccccaacuucaagcggaucaucaagaagggcgaggaccucuucaacaacaagaacaacaagaaguacgaguacuucaagaacuucgacaagaacagcgccgaggagaagaaggaguuccugaagacccgcaacuuccugcugaaggagcucuacuacaacaacuucuacaaggaguuccuguccaagaaggaggaguucgagaagaucgugcuggaggucaaggaggagaagaagucccggggcaacaucaacaacaagaaguccggggugagcuuccagagcaucgacgacuacgacaccaagaucaacaucagcgacuacaucgcguccauccacaagaaggagauggagcgcguggagaaguacaacgaggagaagcagaaggacacggccaaguacauccgcgacuucgucgaggagaucuuccucaccggcuucaucaacuaccuggagaaggacaagcggcugcacuuccucaaggaggaguucagcauccugugcaacaacaacaacaacguggucgacuucaacaucaacaucaacgaggagaagaucaaggaguuccugaaggagaacgacuccaagacccucaaccuguaccuguucuucaacaugaucgacagcaagcgcaucuccgaguuccggaacgagcucgugaaguacaagcaguucaccaagaagcgccuggacgaggagaaggaguuccuggggaucaagaucgagcucuacgagacgcugaucgaguucgugauccugacccgggagaagcucgacaccaagaaguccgaggagaucgacgccuggcuggucgacaagcuguacgugaaggacagcaacgaguacaaggaguacgaggagauccucaagcuguucguggacgagaagauccugagcuccaaggaggcccccuacuacgcgaccgacaacaagacgcccauccuccugagcaacuucgagaagacccgcaaguacggcacccaguccuuccugagcgagauccaguccaacuacaaguacagcaaggucgagaaggagaacaucgaggacuacaacaagaaggaggagaucgagcagaagaagaaguccaacaucgagaagcuccaggaccugaagguggagcugcacaagaagugggagcagaacaagaucaccgagaaggagaucgagaaguacaacaacacgacccggaagaucaacgaguacaacuaccucaagaacaaggaggagcugcagaacguguaccugcuccacgagaugcugagcgaccugcucgcccgcaacgucgccuucuucaacaagugggagcgggacuucaaguucaucgugaucgccaucaagcaguuccugcgcgagaacgacaaggagaaggugaacgaguuccugaacccgcccgacaacagcaaggggaagaaggucuacuucuccgugagcaaguacaagaacaccguggagaacaucgacggcauccacaagaacuucaugaaccucaucuuccugaacaacaaguucaugaaccggaagaucgacaagaugaacugcgccaucugggucuacuuccgcaacuacaucgcgcacuuccugcaccuccacaccaagaacgagaagaucucccugaucagccagaugaaccugcucaucaagcuguucuccuacgacaagaaggugcagaaccacauccucaagagcacgaagacccugcuggagaaguacaacauccagaucaacuucgagaucuccaacgacaagaacgagguguucaaguacaagaucaagaaccggcuguacagcaagaagggcaagaugcucgggaagaacaacaaguucgagauccuggagaacgaguuccuggagaacgucaaggccaugcucgaguacuccgaguga

SEQ ID NO: 11155 - RNA, 4158 nt, Artificial Sequence
  Cas13a variant__Clostridium aminophilum__WP_031473346.1__Cas13a
augaaguucagcaagguggaccacacccgcuccgccgucggcauccagaaggccaccgacagcgugcacgggaugcuguacacggaccccaagaagcaggaggugaacgaccucgacaagcgguucgaccagcugaacgucaaggcgaagcgccuguacaacguguucaaccaguccaaggccgaggaggacgacgacgagaagcgguucggcaagguggucaagaagcucaaccgcgagcugaaggaccuccuguuccaccgggaggugagccgcuacaacuccaucgggaacgccaaguacaacuacuacggcaucaagagcaacccggaggagaucguguccaaccuggggauggucgagagccugaagggcgagcgggacccccagaaggugaucuccaagcuccugcuguacuaccuccgcaagggccugaagcccgggaccgacggccugcggaugauccucgaggccagcugcgggcugcgcaagcuguccggcgacgagaaggagcucaagguguuccugcagacccuggacgaggacuucgagaagaagaccuucaagaagaaccucauccggagcaucgagaaccagaacauggccguccagcccuccaacgagggggacccgaucaucggcaucacgcagggccgcuucaacagccagaagaacgaggagaaguccgcgaucgagcggaugaugagcauguacgccgaccugaacgaggaccaccgcgaggacgugcugcggaagcuccgccggcugaacgugcuguacuucaacgucgacaccgagaagaccgaggagcccacccuccccggggagguggacacgaaccccguguucgaggucuggcacgaccacgagaagggcaaggagaacgaccgccaguucgccaccuucgccaagauccugaccgaggaccgggagacccgcaagaaggagaagcuggcggugaaggaggcccucaacgaccugaaguccgccauccgggaccacaacaucauggccuaccgcugcagcaucaaggugacggagcaggacaaggacgggcuguucuucgaggaccagcgcaucaaccgguucuggauccaccacaucgaguccgccgucgagcgcauccucgcgagcaucaacccggagaagcuguacaagcugcggaucggcuaccucggcgagaagguguggaaggaccugcugaacuaccucagcaucaaguacaucgccguggggaaggccgucuuccacuucgccauggaggaccugggcaagaccgggcaggacaucgagcugggcaagcucuccaacagcguguccgggggccugaccagcuucgacuacgagcagauccgcgccgacgagacccugcagcggcagcucuccgucgagguggcguucgccgccaacaaccuguuccgcgccguggucggccagacggggaagaagaucgagcagagcaaguccgaggagaacgaggaggacuuccugcucuggaaggccgagaagaucgcggagagcaucaagaaggagggcgaggggaacacccugaaguccauccugcaguucuucggcggggccagcuccugggaccugaaccacuucugcgccgccuacggcaacgagagcuccgcccucggcuacgagaccaaguucgcggacgaccugcggaaggccaucuacagccugcgcaacgagaccuuccacuucacgacccucaacaagggguccuucgacuggaacgccaagcugaucggcgacauguucagccacgaggccgcgaccgggaucgccguggagcggacccgcuucuacuccaacaaccugcccauguucuaccgggagagcgaccucaagcgcaucauggaccaccuguacaacacguaccacccccgggccucccaggugcccagcuucaacagcgucuucgugcgcaagaacuuccggcuguuccucuccaacacccugaacaccaacaccagcuucgacacggagguguaccagaagugggaguccggcgucuacuaccuguucaaggagaucuacuacaacagcuuccucccguccggggacgcccaccaccuguucuucgagggccugcgccggauccgcaaggaggccgacaaccuccccaucgugggcaaggaggcgaagaagcggaacgccgugcaggacuucgggcgccgcugcgacgagcugaagaaccugagccucuccgccaucugccagaugaucaugaccgaguacaacgagcagaacaacggcaaccggaaggucaagagcacccgcgaggacaagcggaagcccgacaucuuccagcacuacaagaugcugcugcuccgcacccugcaggaggccuucgccaucuacauccggcgcgaggaguucaaguucaucuucgaccugcccaagacgcucuacgugaugaagccgguggaggaguuccugcccaacuggaaguccgggauguucgacagccuggucgagcgggugaagcagucccccgaccuccagcgcugguacgugcugugcaaguuccugaacggccggcuccugaaccagcugagcggcgucauccgcuccuacauccaguucgcgggggacauccagcggcgcgccaaggccaaccacaaccggcucuacauggacaacacccagcgcguggaguacuacagcaacgugcuggaggucguggacuucugcaucaagggcaccucccgguucagcaacguguucuccgacuacuuccgcgacgaggacgccuacgccgacuaccuggacaacuaccuccaguucaaggacgagaagaucgcggaggucagcagcuucgccgcccugaagaccuucugcaacgaggaggaggugaaggccgggaucuacauggacggcgagaaccccgugaugcagcggaacaucgucauggcgaagcuguucgggccggacgaggugcucaagaacgugguccccaaggugacgcgcgaggagaucgaggaguacuaccagcuggagaagcagaucgcccccuaccggcagaacggcuacugcaaguccgaggaggaccagaagaagcugcuccgcuuccagcggaucaagaaccgcguggaguuccagaccaucaccgaguucagcgagaucaucaacgagcugcugggccagcucaucuccuggagcuuccugcgcgagcgggaccugcucuacuuccagcugggguuccacuaccugugccuccacaacgacaccgagaagcccgccgaguacaaggagaucucccgcgaggacggcaccgucauccggaacgccauccugcaccagguggccgcgauguacgucgggggccugccgguguacacgcucgccgacaagaagcuggccgccuucgagaagggggaggccgacugcaagcugagcaucuccaaggacaccgcgggcgccggcaagaagaucaaggacuucuuccgcuacagcaaguacgugcucaucaaggaccggaugcugaccgaccagaaccagaaguacaccaucuaccuggccgggcucgagcuguucgagaacacggacgagcacgacaacaucaccgacgugcgcaaguacgucgaccacuucaaguacuacgccaccuccgacgagaacgccaugagcauccuggaccucuacuccgagauccacgaccgguucuucaccuacgacaugaaguaccagaagaacguggcgaacaugcuggagaacauccugcuccgccacuucgugcugauccggcccgaguucuucacgggcagcaagaaggucggggagggcaagaagaucacgugcaaggcccgcgcccagaucgagaucgccgagaacgggaugcgguccgaggacuucaccuacaagcugagcgacggcaagaagaacaucuccacgugcaugaucgcggcccgcgaccagaaguaccucaacaccguggcccggcugcuguacuacccccacgaggccaagaaguccaucguggacacccgcgagaagaagaacaacaagaagaccaaccggggcgacgggaccuucaacaagcagaagggcaccgcccgcaaggagaaggacaacgggccccgggaguucaacgacaccggcuucagcaacaccccguucgcgggguucgaccccuuccgcaacagcuga

SEQ ID NO: 11156 - RNA, 4035 nt, Artificial Sequence
  Cas13a variant__Eubacterium rectale__CVRQ01000008.1__Cas13a
augcugcgccgggacaaggaggugaagaagcucuacaacgucuucaaccagauccaggugggcaccaagcccaagaaguggaacaacgacgagaagcugagcccggaggagaacgagcgccgggcccagcagaagaacaucaagaugaagaacuacaaguggcgcgaggccugcuccaaguacguggagagcucccagcggaucaucaacgacgucaucuucuacagcuaccgcaaggcgaagaacaagcugcgguacaugcgcaagaacgaggacauccucaagaagaugcaggaggccgagaagcuguccaaguucagcgggggcaagcuggaggacuucguggccuacacccuccggaagucccugguggucagcaaguacgacacgcaggaguucgacucccuggccgccauggugguguuccucgagugcaucgggaagaacaacaucagcgaccacgagcgcgagaucgucugcaagcugcuggagcucauccggaaggacuucuccaagcuggaccccaacgugaagggcagccagggggcgaacaucgugcgcuccguccggaaccagaacaugaucgugcagccccagggcgaccgcuuccuguucccccagguguacgccaaggagaacgagaccgucaccaacaagaacguggagaaggagggccucaacgaguuccugcugaacuacgccaaccucgacgacgagaagcgggccgagagccugcgcaagcugcggcgcauccucgacguguacuucuccgcgccgaaccacuacgagaaggacauggacaucacccugagcgacaacaucgagaaggagaaguucaacgucugggagaagcacgagugcgggaagaaggagacgggccuguucguggacauccccgacgugcucauggaggccgaggccgagaacaucaagcuggacgccgucguggagaagcgggagcgcaaggugcugaacgaccggguccgcaagcagaacaucaucugcuaccgcuacacccgggccguggucgagaaguacaacuccaacgagccccucuucuucgagaacaacgcgaucaaccaguacuggauccaccacaucgagaacgccguggagcgcauccugaagaacugcaaggccgggaagcuguucaagcuccggaagggcuaccuggccgagaagguguggaaggacgccaucaaccugaucagcaucaaguacaucgcgcucgggaaggccgucuacaacuucgcccuggacgacaucuggaaggacaagaagaacaaggagcugggcaucguggacgagcgcauccggaacggcaucaccuccuucgacuacgagaugaucaaggcccacgagaaccuccagcgcgagcuggccguggacaucgcguucagcgucaacaaccuggcccgggccgugugcgacaugagcaaccucgggaacaaggaguccgacuuccugcuguggaagcgcaacgacaucgccgacaagcucaagaacaaggacgacauggccagcguguccgcgguccugcaguucuucggcggcaagagcuccugggacaucaacaucuucaaggacgccuacaaggggaagaagaaguacaacuacgaggugcgguucaucgacgaccugcgcaaggccaucuacugcgcccggaacgagaacuuccacuucaagaccgcgcucgugaacgacgagaaguggaacacggagcuguucggcaagaucuucgagcgcgagaccgaguucugccugaacgucgagaaggaccgguucuacagcaacaaccucuacauguucuaccagguguccgagcugcgcaacaugcuggaccaccuguacagccgguccgugagccgcgccgcccagguccccuccuacaacagcgugaucgugcggaccgccuucccggaguacaucaccaacguccucggguaccagaagcccuccuacgacgccgacacgcugggcaagugguacagcgcgugcuacuaccugcucaaggagaucuacuacaacuccuuccugcagagcgaccgcgcccugcagcuguucgagaaguccgugaagacccucagcugggacgacaagaagcagcagcgggccguggacaacuucaaggaccacuucuccgacaucaagagcgccugcaccagccuggcccaggucugccagaucuacaugaccgaguacaaccagcagaacaaccagaucaagaaggugcgcuccagcaacgacuccaucuucgaccagcccguguaccagcacuacaagguccuccugaagaaggcgaucgccaacgccuucgccgacuaccugaagaacaacaaggaccucuucggguucaucggcaagcccuucaaggccaacgagauccgcgagaucgacaaggagcaguuccugccggacuggacgagccggaaguacgaggcgcugugcaucgagguguccgggagccaggagcuccagaagugguacaucgugggcaaguuccugaacgcccgcucccugaaccucauggucggcagcaugcgguccuacauccaguacgugaccgacaucaagcgccgggccgccagcaucgggaacgagcugcacguguccguccacgacguggagaagguggagaaguggguccaggugaucgaggugugcagccugcucgcgucccgcaccagcaaccaguucgaggacuacuucaacgacaaggacgacuacgcccgguaccugaaguccuacgucgacuucagcaacguggacaugcccuccgaguacagcgcccugguggacuucagcaacgaggagcaguccgaccucuacgucgaccccaagaaccccaaggugaaccgcaacaucgugcacagcaagcuguucgccgccgaccacauccugcgggacaucgucgagccgguguccaaggacaacaucgaggaguucuacagccagaaggcggagaucgccuacugcaagaucaagggcaaggagaucaccgccgaggagcagaaggccgugcucaaguaccagaagcugaagaaccgcgucgagcugcgggacaucguggaguacggggagaucaucaacgagcuccugggccagcugaucaacugguccuucaugcgcgagcgggaccuccuguacuuccagcugggguuccacuacgacugccuccgcaacgacagcaagaagcccgagggcuacaagaacaucaagguggacgagaacuccaucaaggacgccauccuguaccagaucaucggcauguacgucaacggggugacgguguacgcgcccgagaaggacggcgacaagcugaaggagcagugcgucaagggcggggugggggucaaggugagcgccuuccaccgguacuccaaguaccucggccugaacgagaagacccuguacaacgccggccucgagaucuucgagguggucgccgagcacgaggacaucaucaaccugcgcaacgggaucgaccacuucaaguacuaccugggcgacuaccggagcaugcucuccaucuacagcgagguguucgaccgcuucuucaccuacgacaucaaguaccagaagaacgugcugaaccugcuccagaacauccugcugcggcacaacgucaucguggagcccauccucgaguccggguucaagaccaucggcgagcagacgaagccgggcgccaagcugagcauccgcuccaucaagagcgacaccuuccaguacaaggugaagggcgggacccugaucaccgacgcgaaggacgagcgguaccucgagacgauccgcaagauccuguacuacgccgagaacgaggaggacaaccugaagaaguccgucguggugaccaacgccgacaaguacgagaagaacaaggagagcgacgaccagaacaagcagaaggagaagaagaacaaggacaacaaggggaagaagaacgaggagaccaaguccgacgccgagaagaacaacaacgagcgccucagcuacaaccccuucgcgaaccugaacuucaagcugagcaacuga

SEQ ID NO: 11157 - RNA, 3858 nt, Artificial Sequence
  Cas13a variant__Herbinix hemicellulosilytica__CRZ35554.1__Cas13a
augaagcugacccgccggcgcaucagcggcaacuccguggaccagaagaucaccgccgccuucuaccgggacaugagccaggggcuccuguacuacgacuccgaggacaacgacugcacggacaaggucaucgagagcauggacuucgagcgcuccuggcggggccgcauccugaagaacggggaggacgacaagaaccccuucuacauguucgugaagggccucguggggagcaacgacaagaucgucugcgagccgaucgacguggacuccgaccccgacaaccuggacauccugaucaacaagaaccucaccggcuucggccggaaccugaaggcgcccgacagcaacgacacccuggagaaccucauccgcaagauccaggccgggauccccgaggaggaggugcugccggagcugaagaagaucaaggagaugauccagaaggacaucgucaaccggaaggagcagcuccugaaguccaucaagaacaaccgcauccccuucagccuggagggcuccaagcucgugcccagcaccaagaagaugaaguggcuguucaagcugaucgacgugcccaacaagacguucaacgagaagaugcucgagaaguacugggagaucuacgacuacgacaagcugaaggccaacaucaccaaccggcuggacaagaccgacaagaaggcccgcuccaucagccgggccgucuccgaggagcuccgcgaguaccacaagaaccugcggaccaacuacaaccgcuucgugagcggggaccggccggcggccggccuggacaacgggggcuccgccaaguacaaccccgacaaggaggaguuccuccuguuccugaaggagguggagcaguacuucaagaaguacuuccccgucaagagcaagcacuccaacaagagcaaggacaagagccucguggacaaguacaagaacuacugcuccuacaagguggucaagaaggaggugaaccgcagcaucaucaaccagcugguggccggccugauccagcaggggaagcuccuguacuacuucuacuacaacgacacguggcaggaggacuuccugaacuccuacggccucagcuacauccaggucgaggaggcguucaagaaguccgugaugaccagccuguccugggggaucaaccggcugaccagcuucuucaucgacgacuccaacaccgugaaguucgacgacaucacgaccaagaaggccaaggaggccaucgagagcaacuacuucaacaagcuccggaccugcucccgcaugcaggaccacuucaaggagaagcuggccuucuucuaccccgucuacgugaaggacaagaaggaccgcccggacgacgacaucgagaaccugaucgugcucgucaagaacgccaucgagagcguguccuaccugcgcaaccggaccuuccacuucaaggagagcucccugcucgagcugcugaaggagcucgacgacaagaacagcggccagaacaagaucgacuacuccgucgcggccgaguucaucaagcgcgacaucgagaaccuguacgacguguuccgggagcagauccgcagccugggcaucgccgaguacuacaaggccgacaugaucuccgacugcuucaagacgugcgggcucgaguucgcccuguacagccccaagaacagccugaugcccgcguucaagaacguguacaagcggggcgccaaccugaacaaggccuacauccgcgacaaggggcccaaggagaccggcgaccaggggcagaacuccuacaaggcccucgaggaguaccgggagcugaccugguacaucgaggucaagaacaacgaccagagcuacaacgccuacaagaaccugcuccagcugaucuacuaccacgcguuccugccggaggugcgcgagaacgaggcccucaucaccgacuucaucaaccggacgaaggaguggaaccgcaaggagaccgaggagcggcugaacaccaagaacaacaagaagcacaagaacuucgacgagaacgacgacaucaccgugaacacguaccgcuacgaguccauccccgacuaccagggcgagagccuggacgacuaccucaagguccugcagcggaagcagauggcccgcgccaaggaggugaacgagaaggaggagggcaacaacaacuacauccaguucauccgggacguggucgugugggccuucggggcguaccuggagaacaagcucaagaacuacaagaacgagcugcagccgccccuguccaaggagaacaucggccucaacgacacccugaaggagcuguuccccgaggagaaggucaagagccccuucaacaucaagugccgcuucuccaucagcaccuucaucgacaacaaggggaaguccaccgacaacacgagcgccgaggccgugaagaccgacggcaaggaggacgagaaggacaagaagaacaucaagcggaaggaccuccugugcuucuaccuguuccuccgccugcuggacgagaacgagaucugcaagcuccagcaccaguucaucaaguaccggugcucccugaaggagcgccgcuuccccgggaaccggaccaagcuggagaaggagaccgagcuccuggccgagcuggaggagcucauggagcuggugcgcuucacgaugcccagcaucccggagaucuccgcgaaggccgagagcggcuacgacaccaugaucaagaaguacuucaaggacuucaucgagaagaagguguucaagaaccccaagaccuccaaccuguacuaccacagcgacuccaagacccccgucacgcggaaguacauggcccuccugaugcgcagcgcgccccugcaccucuacaaggacaucuucaagggcuacuaccugaucaccaagaaggagugccuggaguacaucaagcucagcaacaucaucaaggacuaccagaacucccugaacgagcugcacgagcagcucgagcggaucaagcucaagagcgagaagcagaacgggaaggacucccuguaccuggacaagaaggacuucuacaaggugaaggaguacguggagaaccuggagcaggucgcccgcuacaagcaccuccagcacaagaucaacuucgagagccuguaccggaucuuccgcauccacguggacaucgccgcccggauggugggcuacacccaggacugggagcgcgacaugcacuuccuguucaaggcccuggucuacaacggggugcucgaggagcggcgcuucgaggccaucuucaacaacaacgacgacaacaacgacggccggaucgugaagaagauccagaacaaccugaacaacaagaaccgcgagcuggucuccaugcucugcuggaacaagaagcugaacaagaacgaguucggggccaucaucuggaagcggaacccgaucgcgcaccugaaccacuucacccagaccgagcagaacagcaaguccagccucgagucccugaucaacagccugcgcauccuccuggccuacgaccggaagcgccagaacgccgugacgaagaccaucaacgaccugcuccugaacgacuaccacauccggaucaagugggagggccgcguggacgagggccagaucuacuucaacaucaaggagaaggaggacaucgagaacgagcccaucauccaccugaagcaccuccacaagaaggacugcuacaucuacaagaacuccuacauguucgacaagcagaaggaguggaucugcaacgggaucaaggaggaggucuacgacaagagcauccugaagugcaucggcaaccuguucaaguucgacuacgaggacaagaacaaguccagcgccaaccccaagcacaccuga

SEQ ID NO: 11158 - RNA, 4314 nt, Artificial Sequence
  Cas13a variant__Lachnospiraceae bacterium__WP_022785443.1__Cas13a
augaagaucagcaaggugcgcgaggagaaccggggcgccaagcugaccgucaacgccaagaccgcggugguguccgagaaccgcagccaggaggggauccucuacaacgaccccucccgguacggcaagagccgcaagaacgacgaggaccgggaccgcuacaucgagucccggcucaagagcuccgggaagcuguaccgcaucuucaacgaggacaagaacaagcgggagacggacgagcugcagugguuccugagcgagaucgucaagaagaucaaccgccggaacggccuggugcucuccgacaugcugagcguggacgaccgcgccuucgagaaggccuucgagaaguacgccgagcuguccuacaccaaccggcgcaacaaggucagcggguccccggccuucgagaccugcggcguggacgcggccaccgccgagcggcucaagggcaucaucagcgagacgaacuucaucaaccgcaucaagaacaacaucgacaacaagguguccgaggacaucaucgaccggaucaucgccaaguaccugaagaagucccugugccgcgagcgggucaagcgcgggcucaagaagcugcugaugaacgcguucgaccuccccuacagcgaccccgacaucgacgugcagcgggacuucaucgacuacgugcuggaggacuucuaccacguccgcgccaagagccaggugucccgcagcaucaagaacaugaacaugcccgugcagccggagggcgacgggaaguucgccaucaccgucagcaagggcgggaccgaguccggcaacaagcggagcgccgagaaggaggccuucaagaaguuccuguccgacuacgcgagccucgacgagcgcgugcgggacgacaugcugcgccggaugcgccggcuggugguccucuacuucuacggcuccgacgacagcaagcuguccgacgugaacgagaaguucgacgugugggaggaccacgccgcccgccgggucgacaaccgcgaguucaucaagcugccccucgagaacaagcuggccaacgggaagaccgacaaggacgccgagcggauccgcaagaacacggugaaggagcuguaccggaaccagaacaucggcugcuaccgccaggcggugaaggccgucgaggaggacaacaacgggcgguacuucgacgacaagaugcucaacauguucuucauccaccgcaucgaguacggcguggagaagaucuacgccaaccugaagcaggucaccgaguucaaggcccggaccggcuaccugagcgagaagaucuggaaggaccucaucaacuacaucuccaucaaguacaucgccauggggaaggcgguguacaacuacgccauggacgagcugaacgccagcgacaagaaggagaucgagcugggcaagaucuccgaggaguaccucagcgggaucuccagcuucgacuacgagcugaucaaggccgaggagaugcugcagcgcgagaccgccguguacgucgcguucgccgcccggcaccucuccagccagacgguggagcuggacuccgagaacagcgacuuccugcuccugaagcccaagggcaccauggacaagaacgacaagaacaagcuggccuccaacaacauccucaacuuccugaaggacaaggagacccugcgcgacaccauccuccaguacuucgggggccacagccuguggacggacuuccccuucgacaaguaccuggcgggcgggaaggacgacguggacuuccucaccgaccugaaggacgucaucuacagcaugcgcaacgacuccuuccacuacgccaccgagaaccacaacaacggcaaguggaacaaggagcugaucagcgccauguucgagcacgagaccgagcggaugacgguggugaugaaggacaaguucuacuccaacaaccugccgauguucuacaagaacgacgaccucaagaagcugcugaucgaccucuacaaggacaacgucgagcgcgccagccaggugcccuccuucaacaagguguucguccggaagaacuuccccgcccuggugcgcgacaaggacaaccuggggaucgagcucgaccugaaggcggacgccgacaagggcgagaacgagcugaaguucuacaacgcccucuacuacauguucaaggagaucuacuacaacgccuuccugaacgacaagaacgugcgggagcgcuucaucaccaaggccaccaaggucgcggacaacuacgaccggaacaaggagcgcaaccugaaggaccggaucaagagcgccggguccgacgagaagaagaagcuccgcgagcagcugcagaacuacaucgccgagaacgacuucggccagcggaucaagaacaucguccaggugaaccccgacuacacccuggcccagaucugccagcucaucaugacggaguacaaccagcagaacaacggcugcaugcagaagaaguccgccgcgcgcaaggacaucaacaaggacagcuaccagcacuacaagaugcugcugcucgugaaccugcggaaggccuuccuggaguucaucaaggagaacuacgccuucgugcucaagccguacaagcacgaccugugcgacaaggccgacuucgugcccgacuucgcgaaguacgucaagcccuacgccgggcugaucagccgcguggccggcuccagcgagcuccagaagugguacaucgugucccgguuccugagccccgcccaggccaaccacaugcugggguuccuccacuccuacaagcaguacgucugggacaucuaccgccgggcgagcgagaccggcaccgagaucaaccacuccaucgccgaggacaagaucgccgggguggacaucaccgacguggacgccgucaucgaccugagcgugaagcugugcggcacgaucagcuccgagaucagcgacuacuucaaggacgacgagguguacgccgaguacaucuccagcuaccucgacuucgaguacgacggcgggaacuacaaggacucccugaaccgcuucugcaacagcgacgcggucaacgaccagaagguggcccuguacuacgacggcgagcacccgaagcucaaccggaacaucauccuguccaagcuguacggggagcgccgguuccucgagaagaucaccgaccgcgugagccgcuccgacaucgucgaguacuacaagcugaagaaggagaccagccaguaccagaccaagggcaucuucgacuccgaggacgagcagaagaacaucaagaaguuccaggagaugaagaacaucguggaguuccgggaccugauggacuacagcgagaucgccgacgagcuccagggccagcugaucaacuggaucuaccugcgcgagcgggaccucaugaacuuccagcugggguaccacuacgccugccugaacaacgacuccaacaagcaggccacguacgugacccucgacuaccagggcaagaagaaccgcaagaucaacggggcgauccuguaccagaucugcgccauguacaucaacggccugccccucuacuacgucgacaaggacagcuccgaguggaccgugagcgacgggaaggaguccaccggcgccaagaucggcgaguucuaccgguacgccaagagcuucgagaacacguccgacugcuacgcgagcgggcuggagaucuucgagaacaucagcgagcacgacaacaucaccgagcugcgcaacuacaucgagcacuuccgguacuacuccagcuucgaccgcuccuuccucggcaucuacagcgagguguucgaccgguucuucaccuacgaccugaaguaccgcaagaacguccccaccauccuguacaacauccuccugcagcacuucgugaacgugcgguucgaguucgucuccgggaagaagaugaucggcaucgacaagaaggaccgcaagaucgccaaggagaaggagugcgcccggaucaccauccgcgagaagaacgggguguacagcgagcaguucacguacaagcugaagaacggcaccguguacgucgacgcccgggacaagcgcuaccuccaguccaucauccggcugcuguucuaccccgagaaggugaacauggacgagaugaucgaggugaaggagaagaagaagccgagcgacaacaacaccggcaagggguacuccaagcgcgaccggcagcaggaccgcaaggaguacgacaaguacaaggagaagaagaagaaggagggcaacuuccucagcgggaugggcgggaacaucaacugggacgagaucaacgcccagcugaagaacuga

SEQ ID NO: 11159 - RNA, 3156 nt, Artificial Sequence
  Cas13a variant__Listeria newyorkensis__WP_036091002.1__Cas13a
augaagaucaccaagaugcgcguggacggccggaccaucgucauggagcgcacgagcaaggaggggcagcugggcuacgaggggaucgacggcaacaagaccaccgagaucaucuucgacaagaagaaggaguccuucuacaagagcauccucaacaagaccgugcggaagcccgacgagaaggagaagaaccgccggaagcaggccaucaacaaggccaucaacaaggagaucacggagcugaugcuggcggugcuccaccaggaggucccgucccagaagcugcacaaccucaagagccugaacaccgagucccugaccaagcuguucaagcccaaguuccagaacaugaucagcuacccgcccuccaagggggccgagcacgugcaguucugccucaccgacaucgccgugcccgccauccgcgaccuggacgagaucaagcccgacuggggcaucuucuucgagaagcugaagcccuacacggacugggccgagagcuacauccacuacaagcagaccaccauccagaaguccaucgagcagaacaagauccagagccccgacuccccgcggaagcucguccugcagaaguacgugaccgcguuccugaacggcgagccccucgggcuggaccugguggccaagaaguacaagcucgccgaccuggccgagagcuucaagcuggucgaccucaacgaggacaaguccgcgaacuacaagaucaaggccugccugcagcagcaccagcgcaacauccuggacgagcucaaggaggaccccgagcugaaccaguacggcaucgaggugaagaaguacauccagcgguacuuccccaucaagcgcgccccgaaccggagcaagcacgcccgcgccgacuuccugaagaaggagcucaucgaguccacgguggagcagcaguucaagaacgcggucuaccacuacgugcuggagcaggggaagauggaggccuacgagcugaccgaccccaagaccaaggaccuccaggacauccggagcggcgaggccuucuccuucaaguucaucaacgccugcgccuucgcgagcaacaaccugaagaugauccugaaccccgagugcgagaaggacauccucgggaagggcaacuucaagaagaaccugcccaacuccaccacgcgcagcgacguggucaagaagaugaucccguucuucagcgacgagcugcagaacgugaacuucgacgaggccaucugggccauccggggcuccauccagcagauccgcaacgagguguaccacugcaagaagcacagcuggaaguccauccucaagaucaagggguucgaguucgagcccaacaacaugaaguacgccgacagcgacaugcagaagcugauggacaaggacaucgccaagauccccgaguucaucgaggagaagcugaaguccagcggcgucgugcgguucuaccgccacgacgagcuccaguccaucugggagaugaagcagggguucagccugcugaccaccaacgcgcccuucgugccguccuucaagcgggucuacgccaagggccacgacuaccagaccagcaagaaccgcuacuacaaccucgaccugacgaccuucgacauccuggaguacggcgaggaggacuuccgggcccgcuacuuccucaccaagcugguguacuaccagcaguucaugcccugguucaccgccgacaacaacgccuuccgcgacgcggccaacuucgugcugcggcucaacaagaaccgccagcaggacgccaaggccuucaucaacauccgggaggucgaggagggggagaugccccgcgacuacaugggcuacgugcaggggcagaucgcgauccacgaggacuccaucgaggacacgcccaaccacuucgagaaguucaucagccaggucuucaucaagggcuucgaccggcacaugcgcuccgccaaccugaaguucaucaagaacccgcggaaccaggggcuggagcagagcgagaucgaggagauguccuucgacaucaagguggagcccagcuuccugaagaacaaggacgacuacaucgccuucuggaucuucugcaagaugcucgacgcccgccaccuguccgagcugcggaacgagaugaucaaguacgacggccaccucaccggcgagcaggagaucaucgggcuggcccugcucggcguggacagccgcgagaacgacuggaagcaguucuucuccagcgagcgggaguacgagaagaucaugaagggguacgucguggaggagcuguaccagcgcgagcccuaccggcagagcgacggcaagacccccauccuguuccgcgggguggagcaggcgcggaaguacggcaccgagacggucauccagcgccucuucgacgccaacccggaguucaagguguccaagugcaaccuggccgagugggagcggcagaaggagaccaucgaggagaccaucaagcgccggaaggagcugcacaacgagugggccaagaaccccaagaagccccagaacaacgccuucuucaaggaguacaaggagugcugcgacgcgaucgacgccuacaacuggcacaagaacaagaccacgcucgccuacgugaacgagcugcaccaccuccugaucgagauccugggccgcuacgucggguacguggccaucgccgaccgcgacuuccagugcauggcgaaccaguacuucaagcacagcggcaucaccgagcggguggaguacuggggcgacaaccgccugaaguccaucaagaagcucgacaccuuccugaagaaggaggggcuguucgucagcgagaagaacgcccggaaccacaucgcccaccucaacuaccugucccucaagagcgagugcacccugcuguaccuguccgagcgccuccgggagaucuucaaguacgaccgcaagcugaagaacgccgugagcaagucccugaucgacauccucgaccggcacgggaugagcguggucuucgcgaaccugaaggagaacaagcaccgccuggugaucaagucccucgagccgaagaagcugcggcaccugggcggcaagaagaucgacgggggcuacaucgagacgaaccaggugagcgaggaguacugcgggaucgucaagcgccuccuggagauguga

SEQ ID NO: 11160 - RNA, 3363 nt, Artificial Sequence
  Cas13a variant__Listeria seeligeri__WP_012985477.1__Cas13a
auguggaucagcaucaagacccugauccaccaccucggcgugcuguucuucugcgacuacauguacaaccgccgggagaagaagaucaucgaggucaagaccaugcgcaucacgaagguggagguggaccggaagaagguccugaucucccgcgacaagaacgggggcaagcucguguacgagaacgagaugcaggacaacaccgagcagaucaugcaccacaagaaguccagcuucuacaagagcguggucaacaagaccaucugccggcccgagcagaagcagaugaagaagcuggugcacgggcugcuccaggagaacucccaggagaagaucaaggugagcgacgucaccaagcugaacaucuccaacuuccugaaccaccgcuucaagaagucccucuacuacuucccggagaacagccccgacaagagcgaggaguaccggaucgagaucaaccugucccagcugcucgaggacagccugaagaagcagcagggcacguucaucugcugggaguccuucagcaaggacauggagcuguacaucaacugggccgagaacuacaucuccagcaagaccaagcucaucaagaaguccauccgcaacaaccggauccagagcaccgagucccgcagcgggcagcugauggaccgguacaugaaggacauccugaacaagaacaagcccuucgacauccagagcguguccgagaaguaccagcucgagaagcugaccagcgcccugaaggcgacguucaaggaggccaagaagaacgacaaggagaucaacuacaagcucaaguccacccugcagaaccacgagcgccagaucaucgaggagcugaaggagaacagcgagcucaaccaguucaacaucgagauccggaagcaccuggagaccuacuuccccaucaagaagaccaaccgcaaggugggcgacauccggaaccuggagaucggcgagauccagaagaucgucaaccaccgccucaagaacaagaucgugcagcggauccugcaggaggggaagcuggccuccuacgagaucgagagcacggugaacuccaacagccuccagaagaucaagaucgaggaggccuucgcccugaaguucaucaacgcgugccuguucgccuccaacaaccuccgcaacauggucuacccggugugcaagaaggacauccugaugaucggcgaguucaagaacagcuucaaggagaucaagcacaagaaguucauccggcaguggucccaguucuucagccaggagaucaccguggacgacaucgagcuggccuccugggggcuccgcggcgccaucgcgcccauccggaacgagaucauccaccugaagaagcacagcuggaagaaguucuucaacaaccccaccuucaaggucaagaaguccaagaucaucaacgggaagaccaaggacgugacgagcgaguuccuguacaaggagacccucuucaaggacuacuucuacuccgagcuggacagcgugcccgagcugaucaucaacaagauggaguccagcaagauccucgacuacuacagcuccgaccagcugaaccaggucuucaccaucccgaacuucgagcugagccuccugaccuccgccgugcccuucgcccccagcuucaagcgcguguaccugaagggcuucgacuaccagaaccaggacgaggcccagcccgacuacaaccucaagcugaacaucuacaacgagaaggccuucaacuccgaggcguuccaggcccaguacagccuguucaagauggucuacuaccagguguuccugccgcaguucacgaccaacaacgaccucuucaaguccagcgucgacuucauccugacccugaacaaggagcgcaagggcuacgccaaggccuuccaggacauccggaagaugaacaaggacgagaagcccuccgaguacaugagcuacauccagucccagcucaugcuguaccagaagaagcaggaggagaaggagaagaucaaccacuucgagaaguucaucaaccagguguucaucaagggguucaacagcuucaucgagaagaaccgccugaccuacaucugccaccccacgaagaacaccgugcccgagaacgacaacaucgagaucccguuccacaccgacauggacgacuccaacaucgccuucuggcucaugugcaagcugcuggacgcgaagcagcucagcgagcugcggaacgagaugaucaaguucuccugcagccugcaguccaccgaggagaucagcacguucaccaaggcccgcgaggucaucggccucgcccugcugaacggggagaagggcugcaacgacuggaaggagcuguucgacgacaaggaggccuggaagaagaacaugagccucuacguguccgaggagcugcuccagagccugcccuacacccaggaggacggccagacccccgugaucaaccgguccaucgaccuggucaagaaguacgggacggagaccauccucgagaagcuguucagcuccagcgacgacuacaagguguccgccaaggacaucgcgaagcugcacgaguacgacgugaccgagaagaucgcccagcaggagagccuccacaagcaguggaucgagaagcccggccuggcccgcgacuccgccuggaccaagaaguaccagaacgucaucaacgacaucagcaacuaccagugggccaagacgaagguggagcugacccaggugcggcaccuccaccagcugaccaucgaccugcucucccgccuggcgggguacaugagcaucgccgaccgggacuuccaguucuccagcaacuacauccuggagcgcgagaacuccgaguaccgggucaccagcuggauccuccuguccgagaacaagaacaagaacaaguacaacgacuacgagcuguacaaccucaagaacgccagcaucaagguguccagcaagaacgacccgcagcugaagguggaccugaagcagcuccgccugacccuggaguaccucgagcuguucgacaaccggcugaaggagaagcgcaacaacaucagccacuucaacuaccucaacggccagcuggggaacuccauccuggagcuguucgacgacgcccgggacguccucagcuacgaccgcaagcugaagaacgcgguguccaagagccucaaggagauccuguccagccacggcauggaggugacguucaagccccuguaccagaccaaccaccaccucaagaucgacaagcugcagcccaagaagauccaccaccugggcgagaaguccaccgucagcuccaaccaggugagcaacgaguacugccagcucgugcggacccugcugacgaugaaguga

SEQ ID NO: 11161 - RNA, 3465 nt, Artificial Sequence
  Cas13a variant__Paludibacter propionicigenes__WP_013443710.1__Cas13a
augcgcgugagcaaggucaaggugaaggacggcgggaaggacaagauggugcugguccaccggaagaccaccggcgcccagcucguguacuccgggcagcccgugagcaacgagacguccaacauccugccggagaagaagcgccagagcuucgaccuguccacccucaacaagaccaucaucaaguucgacaccgccaagaagcagaagcugaacgucgaccaguacaagaucguggagaagaucuucaaguaccccaagcaggagcugcccaagcagaucaaggcggaggagauccuccccuuccugaaccacaaguuccaggagccggugaaguacuggaagaacggcaaggaggagagcuucaaccugacgcuccugaucgucgaggccgugcaggcccaggacaagcggaagcugcagcccuacuacgacuggaagaccugguacauccagaccaaguccgaccuccugaagaaguccaucgagaacaaccgcaucgaccugaccgagaaccucagcaagcggaagaaggcccugcuggccugggagacggaguucaccgcgagcggguccaucgaccucacccacuaccacaagguguacaugaccgacguccugugcaagaugcugcaggacgugaagccccucacggacgacaagggcaagaucaacaccaacgccuaccaccgcggccugaagaaggcccugcagaaccaccagcccgccaucuucgggacccgggaggugccgaacgaggcgaaccgcgccgacaaccagcucagcaucuaccaccuggaggucgugaaguaccuggagcacuacuuccccaucaagaccuccaagcggcgcaacacggccgacgacaucgcccacuaccucaaggcccagacccugaagaccaccaucgagaagcagcuggugaacgcgauccgggccaacaucauccagcagggcaagacgaaccaccacgagcucaaggccgacaccaccagcaacgaccugauccgcaucaagaccaacgaggccuucguccugaaccucacggggaccugcgccuucgcggccaacaacauccggaacaugguggacaacgagcagaccaacgacauccugggcaagggggacuucaucaagucccugcucaaggacaacaccaacagccagcuguacuccuucuucuucggcgagggccugagcacgaacaaggccgagaaggagacccagcucugggggauccgcggcgccgugcagcagauccggaacaacgucaaccacuacaagaaggacgcccugaagaccguguucaacaucuccaacuucgagaaccccaccaucacggaccccaagcagcagaccaacuacgcggacaccaucuacaaggcccgcuucaucaacgagcuggagaagaucccggaggccuucgcccagcagcucaagaccgggggcgccgugagcuacuacacgaucgagaaccucaagagccugcugaccaccuuccaguucucccugugccggagcaccauccccuucgcgcccggcuucaagaaggucuucaacgggggcaucaacuaccagaacgccaagcaggacgaguccuucuacgagcugaugcucgagcaguaccugcgcaaggagaacuucgccgaggagagcuacaacgcccgguacuucaugcugaagcugaucuacaacaaccucuuccugcccggguucaccacggaccgcaaggcguucgccgacuccgugggcuucguccagaugcagaacaagaagcaggccgagaaggugaacccgcggaagaaggaggccuacgccuucgaggcggugcgccccaugaccgccgccgacagcaucgccgacuacauggccuacguccaguccgagcugaugcaggagcagaacaagaaggaggagaagguggcggaggagacccgcaucaacuucgagaaguucgugcuccaggucuucaucaagggguucgacagcuuccugcgggccaaggaguucgacuucgugcagaugccccagccccagcugaccgccacggccuccaaccagcagaaggccgacaagcucaaccagcuggaggcgagcaucaccgccgacugcaagcugaccccgcaguacgccaaggccgacgacgcgacccacaucgccuucuacguguucugcaagcuccuggacgccgcccaccuguccaaccuccgcaacgagcugaucaaguuccgggagagcgucaacgaguucaaguuccaccaccuccuggagaucaucgagaucugccugcuguccgccgacguggugcccacggacuaccgcgaccucuacagcuccgaggcggacugccuggcccggcugcgccccuucaucgagcagggcgccgacaucaccaacuggagcgaccucuucguccaguccgacaagcacagccccgugauccacgccaacaucgagcuguccgugaaguacggcaccaccaagcugcucgagcagaucaucaacaaggacacgcaguucaagaccaccgaggccaacuucaccgcguggaacacggcccagaaguccaucgagcagcugaucaagcagcgggaggaccaccacgagcagugggucaaggccaagaacgccgacgacaaggagaagcaggagcgcaagcgggagaaguccaacuucgcccagaaguucaucgagaagcacggggacgacuaccuggacaucugcgacuacaucaacaccuacaacuggcucgacaacaagaugcacuucgugcaccugaaccgccugcacggccucaccaucgagcugcuggggcggauggcgggcuucguggcccucuucgaccgcgacuuccaguucuucgacgagcagcagaucgccgacgaguucaagcugcacggguucgucaaccugcacagcaucgacaagaagcucaacgaggugccgaccaagaagaucaaggagaucuacgacauccggaacaagaucauccagaucaacggcaacaagaucaacgagagcgugcgcgccaaccugauccaguucaucagcagcaagcggaacuacuacaacaacgcguuccugcacgucuccaacgacgagaucaaggagaagcagauguacgacauccgcaaccacaucgcccacuucaacuaccucacgaaggacgccgccgacuucagccugaucgaccugaucaacgagcuccgggagcugcugcacuacgaccgcaagcucaagaacgccguguccaaggcguucaucgaccuguucgacaagcacggcaugauccugaagcucaagcugaacgccgaccacaagcugaagguggagagccucgagcccaagaagaucuaccaccugggguccagcgccaaggacaagcccgaguaccaguacugcaccaaccaggucaugauggccuacugcaacaugugccggucccugcucgagaugaagaaguga

SEQ ID NO: 11162 - RNA, 3858 nt, Artificial Sequence
  Cas13a variant__Rhodobacter capsulatus__ETD76934.1__Cas13a
augcagaucggcaaggugcaggggcgcaccaucagcgaguucggcgaccccgccgggggccugaagcggaagaucuccaccgacgggaagaaccgcaaggagcucccggcccaccugagcuccgaccccaaggcgcugaucggccaguggaucagcggcaucgacaagaucuaccggaagcccgacucccgcaagagcgacgggaaggccauccacucccccacgccgagcaagaugcaguucgacgcccgggacgaccucggcgaggccuucuggaagcuggucuccgaggccgggcuggcgcaggacagcgacuacgaccaguucaagcgccggcuccaccccuacggcgacaaguuccagcccgccgacuccggggccaagcugaaguucgaggccgaccccccggagccccaggcguuccacggccgcugguacggcgccaugagcaagcgggggaacgacgccaaggagcuggccgccgcgcucuacgagcaccugcacguggacgagaagcgcaucgacggccagcccaagcggaaccccaagaccgacaaguucgccccggggcugguggucgcccgcgcccucggcaucgaguccagcgugcugccccggggcauggcccgccuggcgcggaacuggggggaggaggagauccagaccuacuucguggucgacguggccgccuccgugaaggaggucgccaaggccgcggugagcgccgcccaggccuucgaccccccccgccagguguccggccggagccucuccccgaaggucggguucgcccuggcggagcaccuggagcgcgugaccggcagcaagcggugcagcuucgaccccgccgccgggcccuccgugcucgcccugcacgacgaggucaagaagacguacaagcgccugugcgcgcggggcaagaacgccgcccgcgccuuccccgccgacaagaccgagcuccuggcgcugaugcgccacacccacgagaaccgggugcgcaaccagauggugcggaugggccgcgucagcgaguaccgggggcagcaggccggcgaccucgcccagucccacuacuggaccagcgccgggcagacggagaucaaggaguccgagaucuucgugcgccugugggugggcgccuucgcgcuggccgggcggagcaugaaggccuggaucgacccgaugggcaagaucgucaacaccgagaagaacgaccgcgaccucaccgccgccgugaacauccggcaggugaucuccaacaaggagauggucgcggaggccauggcccgccggggcaucuacuucggggagacccccgagcuggaccgccugggcgccgaggggaacgagggcuucguguucgcgcuccugcgguaccugcgcgggugccggaaccagacguuccaccucggcgcccgcgccggcuuccugaaggagauccggaaggagcuggagaagacccgcugggggaaggccaaggaggccgagcacgucgugcucaccgacaagaccguggcggccauccgggccaucaucgacaacgacgccaaggcccugggcgcgcgccugcucgccgaccugagcggggccuucgucgcccacuacgccuccaaggagcacuucagcacgcuguacuccgagaucgugaaggcggugaaggacgcccccgaggucagcuccggccucccccgccugaagcugcuccugaagcgggccgacggcgugcgcggguacgugcacggccugcgggacacccgcaagcacgccuucgcgaccaagcucccgcccccccccgccccgcgggagcuggacgaccccgccaccaaggcccgcuacaucgcccugcugcggcucuacgacgggcccuuccgcgcguacgccagcggcaucacggggaccgcccuggccggcccggccgcgcgggccaaggaggccgccaccgcccuggcgcaguccgucaacgugaccaaggccuacagcgacgugauggagggccgcuccagccggcuccgcccccccaacgacggggagacgcugcgggaguaccuguccgcccucaccggcgagaccgccaccgaguuccgcguccagaucggguacgagagcgacagcgagaacgcccggaagcaggcggaguucaucgagaacuaccgccgggacaugcuggccuucauguucgaggacuacauccgcgccaagggcuucgacuggauccugaagaucgagcccggggccacggcgaugacccgggccccggugcuccccgagcccaucgacacccgcggccaguacgagcacuggcaggccgcccuguaccuggugaugcacuucguccccgccuccgacgugagcaaccuccugcaccagcugcggaagugggaggcgcuccagggcaaguacgagcuggugcaggacggggacgccaccgaccaggccgacgcccgccgcgaggcccuggaccucgucaagcgguuccgcgacgugcuggugcuguuccucaagacgggcgaggcgcgguucgaggggcgcgccgccccguucgaccugaagcccuuccgggcccuguucgccaaccccgcgaccuucgaccgccucuucauggccacccccaccacggcccggccggccgaggacgaccccgagggcgacggggcguccgagcccgagcugcgcgucgcccggacccugcgcggccuccggcagaucgcccgcuacaaccacauggccgugcugagcgaccuguucgccaagcacaaggugcgggacgaggaggucgcgcgccucgccgagaucgaggacgagacccaggagaagucccagaucguggccgcccaggagcugcggaccgaccugcacgacaaggugaugaagugccaccccaagaccaucagcccggaggagcgccaguccuacgccgcggccaucaagacgaucgaggagcaccgguuccucgucggccgcguguaccugggggaccaccugcggcuccaccgccugaugauggacgugaucggccgccugaucgacuacgccggggccuacgagcgggacaccggcaccuuccucaucaacgccagcaagcagcugggggcgggcgccgacugggccgucaccaucgccggcgcggccaacacggacgcccgcacccagacccggaaggaccuggcccacuucaacgugcucgaccgcgccgacgggacccccgaccugacggcgcuggugaaccgggcccgcgagaugauggccuacgaccggaagcgcaagaacgccgucccccgguccauccucgacaugcuggcccgccugggccucacccugaaguggcagaugaaggaccaccugcuccaggacgcgaccaucacccaggccgccaucaagcaccuggacaaggugcggcugacgguggggggccccgccgccgucaccgaggcgcgcuucagccaggacuaccuccagaugguggccgccguguucaacggcuccguccagaacccgaagccccggcgccgggacgacggggacgccuggcacaagccccccaagccggccaccgcgcagagccagcccgaccagaagcccccgaacaaggcccccuccgccggcagccgccugccccccccgcaggugggggagguguacgagggcgucguggugaaggucaucgacaccgggucccugggcuuccucgccguggagggcguggcggggaacaucggccugcacaucagccggcugcgccggauccgcgaggacgccaucaucgucgggcggcgcuaccgcuuccggguggagaucuacgugccccccaaguccaacacgagcaagcucaacgccgccgaccugguccgcaucgacuga

SEQ ID NO: 11163 - RNA, 1578 nt, Artificial Sequence
  Cas13a variant__Corynebacterium ulcerans__WP_038617242.1__Cas13
augcccaaguacugccugaccgcccgcuucccgcucggcguguaccuggggcacaccggcgacgccaaccgggacgcguaccccgaccccgcccgccugcacgccgcccucaugaacgccgcggcccaggggguccacgccgaggaggaccccaacgagcaccagcugcggccgagccagcagucccugcaggcccuccaguggcuggaggcgcacccgcccacgggccuggccaugcccgagcagcaguggcucagccccgacaccucccgcaugauguaccggaacguggggagcgugaagaucgacaagaccggcgucacccgcgccacggagaaccgggccguguccgacggcgugagcgucaacggggccuacggcuacaucugggacgagaugcccguggacaucgcggaggccaucaccgcccugcugcccgacguggccugccucggggaggccuccagccuggucgugcuggagcagcaggagaucgaggcgacccucacccuggacccccaggccacggccuucuccaccgagcgcgugcagguccggaucgcccugccgggccgcacccagcaccuccgggagguguuccacgcccgcuacgggaagaagccgcccagcaagaaggcggacaaguuccugaaggacgaccccauccacgacccgcccauccccaaggaccaccugggcaccgcccgguaccuccgcgugaacgccgccgacaaggagugcgucacgcccuggaccaaggugauccugcuggaggugcacggcaagcagcucggggccaaggagcagguccgggcggccguggcccugcaccgcgcccugaucgcgcggauccgcaccgacgugucccccgucaucaccggccgguacgccgccggggcccagcgccccgccaacaaccucgcgauccaguacaucccccaccggcaccuggaggcccugggccucaagacgagcgccuucgcccugcuggugccccaggacgccgacuccaccguguacgagcagcucaaccaggcgcugaccggcccguucccccugcgcagcgggggcaagcuccugugccagcugaaguacaacgggcacgucuuccgcggcgacgccuucuggcccgcgccccagccggggaccauccggaugugggagccccucaacguguucauccccgagucccgcccgcacaacaagcagcagggcguccuguggcggcuggccgacgccggccuccugagcguggccuucguguggcgcgacaacuuccccacgaaggagaccgggcccgcccgguacgucgagcugcgcgacgccgccuacaacgcggacgugcggaucuuccacgaccaccccgugucccgcaacacccggcgcuucguccaccggaccaaccgcagccucacgauccagccguggcggggccuggugcaccuggggucccuccagcaggaccgcgccaucaucgcccugggccagagccggcaccucgggggcggccugcugauccccguggacaucccccgcagcgaguucgagaccaugaccuccgagaugacccacgccuga

SEQ ID NO: 11164 - RNA, 3675 nt, Artificial Sequence
  Cas13b variant__Bergeyella zoohelcum__WP_002664492.1__Cas13b
auggagaacaagaccagccugggcaacaacaucuacuacaaccccuucaagccgcaggacaaguccuacuucgccggguacuucaacgccgcgauggagaacaccgacagcguguuccgcgagcucggcaagcggcugaaggggaaggaguacacguccgagaacuucuucgacgccaucuucaaggagaacaucagccuggucgaguacgagcgcuacgugaagcuccuguccgacuacuuccccauggcccggcugcucgacaagaaggaggugcccaucaaggagcgcaaggagaacuucaagaagaacuucaagggcaucaucaaggccguccgggaccugcgcaacuucuacacccacaaggagcacggggagguggagaucaccgacgagaucuucggcgugcuggacgagaugcucaagagcaccguccugacggugaagaagaagaaggugaagaccgacaagaccaaggagauccugaagaaguccaucgagaagcagcucgacauccugugccagaagaagcuggaguaccuccgggacaccgcccgcaagaucgaggagaagcggcgcaaccagcgggagcgcggcgagaaggagcuggucgcgcccuucaaguacagcgacaagcgggacgaccugaucgccgccaucuacaacgacgccuucgacguguacaucgacaagaagaaggacucccucaaggagagcuccaaggcgaaguacaacaccaagagcgacccgcagcaggaggagggggaccugaagauccccaucuccaagaacggcguggucuuccugcucagccuguuccugaccaagcaggagauccacgccuucaaguccaagaucgccggguucaaggccaccgugaucgacgaggccaccgugagcgaggcgacggucucccacggcaagaacagcaucugcuucauggccacccacgagaucuucucccaccucgccuacaagaagcugaagcgcaaggugcggaccgccgagaucaacuacggggaggccgagaacgcggagcagcugagcguguacgccaaggagacccucaugaugcagaugcuggacgagcugagcaagguccccgacgugguguaccagaaccucuccgaggacguccagaagacguucaucgaggacuggaacgaguaccugaaggagaacaacggcgacgugggcaccauggaggaggagcaggucauccaccccgugauccgcaagcgguacgaggacaaguucaacuacuucgccauccgcuuccuggacgaguucgcccaguucccgacccuccgguuccaggugcaccuggggaacuaccugcacgacagccgccccaaggagaaccucaucuccgaccggcgcaucaaggagaagaucaccgucuucggccgccugagcgagcuggagcacaagaaggcccucuucaucaagaacacggagaccaacgaggaccgggagcacuacugggagaucuuccccaaccccaacuacgacuucccgaaggagaacaucuccgugaacgacaaggacuuccccaucgcggggagcauccuggaccgcgagaagcagcccguggccggcaagaucggcaucaaggucaagcugcucaaccagcaguacguguccgagguggacaaggccgucaaggcccaccagcugaagcagcggaaggccagcaagcccuccauccagaacaucaucgaggagaucgugccgaucaacgagagcaaccccaaggaggcgaucguguucgggggccagcccaccgccuaccuguccaugaacgacauccacagcauccucuacgaguucuucgacaagugggagaagaagaaggagaagcuggagaagaagggggagaaggagcugcgcaaggagaucggcaaggagcucgagaagaagaucgucgggaagauccaggcccagauccagcagaucaucgacaaggacaccaacgccaagauccugaagcccuaccaggacggcaacuccacggcgaucgacaaggagaagcugaucaaggaccugaagcaggagcagaacauccuccagaagcugaaggacgagcagaccgugcgggagaaggaguacaacgacuucaucgccuaccaggacaagaaccgcgagaucaacaaggugcgggaccgcaaccacaagcaguaccugaaggacaaccucaagcggaaguacccggaggcccccgcccgcaaggagguccuguacuaccgggagaagggcaagguggccguguggcuggcgaacgacaucaagcgcuucaugcccaccgacuucaagaacgaguggaagggggagcagcacagccuccugcagaagucccuggccuacuacgagcagugcaaggaggagcucaagaaccugcugcccgagaaggucuuccagcaccucccguucaagcugggcggguacuuccagcagaaguaccuguaccaguucuacacgugcuaccucgacaagcggcuggaguacaucagcggccuggugcagcaggccgagaacuucaaguccgagaacaagguguucaagaaggucgagaacgagugcuucaaguuccucaagaagcagaacuacacgcacaaggagcuggacgcccgcgugcagagcauccugggguaccccaucuuccucgagcggggcuucauggacgagaagcccaccaucaucaagggcaagaccuucaaggggaacgaggcccuguucgcggacugguuccgcuacuacaaggaguaccagaacuuccagaccuucuacgacacggagaacuacccccugguggagcucgagaagaagcaggccgaccggaagcgcaagaccaagaucuaccagcagaagaagaacgacgucuucacccugcugauggccaagcacaucuucaaguccguguucaagcaggacagcaucgaccaguucagccucgaggaccuguaccagucccgggaggagcgccugggcaaccaggagcgcgcccggcagaccggggagcgcaacacgaacuacaucuggaacaagaccguggaccucaagcugugcgacggcaagaucaccgucgagaacgugaagcugaagaacgugggggacuucaucaaguacgaguacgaccagcggguccaggccuuccucaaguacgaggagaacaucgaguggcaggcguuccugaucaaggagagcaaggaggaggagaacuacccguacgugguggagcgcgagaucgagcaguacgagaagguccggcgcgaggagcugcucaaggaggugcaccugaucgaggaguacauccuggagaaggugaaggacaaggagauccucaagaagggcgacaaccagaacuucaaguacuacauccugaacggccugcucaagcagcugaagaacgaggacgucgaguccuacaagguguucaaccugaacaccgagcccgaggacgugaacaucaaccagcucaagcaggaggccaccgaccuggagcagaaggccuucguccugacguacauccggaacaaguucgcccacaaccagcuccccaagaaggaguucugggacuacugccaggagaaguacgggaagaucgagaaggagaagaccuacgcggaguacuucgccgagguguucaagaaggagaaggaggcccugaucaaguga

SEQ ID NO: 11165 - RNA, 3675 nt, Artificial Sequence
  Cas13b variant__Bergeyella zoohelcum__WP_002664492.1 modified__Cas13b(R116A,H121A,R1177A,H1182A)
auggagaacaagaccagccugggcaacaacaucuacuacaaccccuucaagccgcaggacaaguccuacuucgccggguacuucaacgccgcgauggagaacaccgacagcguguuccgcgagcucggcaagcggcugaaggggaaggaguacacguccgagaacuucuucgacgccaucuucaaggagaacaucagccuggucgaguacgagcgcuacgugaagcuccuguccgacuacuuccccauggcccggcugcucgacaagaaggaggugcccaucaaggagcgcaaggagaacuucaagaagaacuucaagggcaucaucaaggccguccgggaccuggccaacuucuacaccgcgaaggagcacggggagguggagaucaccgacgagaucuucggcgugcuggacgagaugcucaagagcaccguccugacggugaagaagaagaaggugaagaccgacaagaccaaggagauccugaagaaguccaucgagaagcagcucgacauccugugccagaagaagcuggaguaccuccgcgacaccgcccggaagaucgaggagaagcgccggaaccagcgcgagcggggcgagaaggagcuggucgcccccuucaaguacagcgacaagcgcgacgaccugaucgccgcgaucuacaacgacgccuucgacguguacaucgacaagaagaaggacucccucaaggagagcuccaaggccaaguacaacaccaagagcgacccgcagcaggaggagggggaccugaagauccccaucuccaagaacggcguggucuuccugcucagccuguuccugaccaagcaggagauccacgccuucaaguccaagaucgccggguucaaggcgaccgugaucgacgaggccaccgugagcgaggccacggucucccacggcaagaacagcaucugcuucauggccacccacgagaucuucucccaccucgccuacaagaagcugaagcggaaggugcgcaccgcggagaucaacuacggggaggccgagaacgccgagcagcugagcguguacgccaaggagacccucaugaugcagaugcuggacgagcugagcaagguccccgacgugguguaccagaaccucuccgaggacguccagaagacguucaucgaggacuggaacgaguaccugaaggagaacaacggcgacgugggcaccauggaggaggagcaggucauccaccccgugauccggaagcgcuacgaggacaaguucaacuacuucgccauccgguuccuggacgaguucgcgcaguucccgacccuccgcuuccaggugcaccuggggaacuaccugcacgacagccggcccaaggagaaccucaucuccgaccgccggaucaaggagaagaucaccgucuucggccgccugagcgagcuggagcacaagaaggcccucuucaucaagaacacggagaccaacgaggaccgcgagcacuacugggagaucuuccccaaccccaacuacgacuucccgaaggagaacaucuccgugaacgacaaggacuuccccaucgccgggagcauccuggaccgggagaagcagcccguggccggcaagaucggcaucaaggucaagcugcucaaccagcaguacguguccgagguggacaaggccgucaaggcgcaccagcugaagcagcgcaaggccagcaagcccuccauccagaacaucaucgaggagaucgugccgaucaacgagagcaaccccaaggaggccaucguguucgggggccagcccaccgccuaccuguccaugaacgacauccacagcauccucuacgaguucuucgacaagugggagaagaagaaggagaagcuggagaagaagggggagaaggagcugcggaaggagaucggcaaggagcucgagaagaagaucgucgggaagauccaggcgcagauccagcagaucaucgacaaggacaccaacgccaagauccugaagcccuaccaggacggcaacuccacggccaucgacaaggagaagcugaucaaggaccugaagcaggagcagaacauccuccagaagcugaaggacgagcagaccgugcgcgagaaggaguacaacgacuucaucgccuaccaggacaagaaccgggagaucaacaaggugcgcgaccggaaccacaagcaguaccugaaggacaaccucaagcgcaaguacccggaggcccccgcgcggaaggagguccuguacuaccgcgagaagggcaagguggccguguggcuggccaacgacaucaagcgguucaugcccaccgacuucaagaacgaguggaagggggagcagcacagccuccugcagaagucccuggccuacuacgagcagugcaaggaggagcucaagaaccugcugcccgagaaggucuuccagcaccucccguucaagcugggcggguacuuccagcagaaguaccuguaccaguucuacacgugcuaccucgacaagcgccuggaguacaucagcggccuggugcagcaggccgagaacuucaaguccgagaacaagguguucaagaaggucgagaacgagugcuucaaguuccucaagaagcagaacuacacgcacaaggagcuggacgcgcgggugcagagcauccugggguaccccaucuuccucgagcgcggcuucauggacgagaagcccaccaucaucaagggcaagaccuucaaggggaacgaggcccuguucgccgacugguuccgguacuacaaggaguaccagaacuuccagaccuucuacgacacggagaacuacccccugguggagcucgagaagaagcaggccgaccgcaagcggaagaccaagaucuaccagcagaagaagaacgacgucuucacccugcugauggccaagcacaucuucaaguccguguucaagcaggacagcaucgaccaguucagccucgaggaccuguaccagucccgcgaggagcggcugggcaaccaggagcgcgcgcgccagaccggggagcggaacacgaacuacaucuggaacaagaccguggaccucaagcugugcgacggcaagaucaccgucgagaacgugaagcugaagaacgugggggacuucaucaaguacgaguacgaccagcgcguccaggccuuccucaaguacgaggagaacaucgaguggcaggccuuccugaucaaggagagcaaggaggaggagaacuacccguacgugguggagcgggagaucgagcaguacgagaagguccgccgggaggagcugcucaaggaggugcaccugaucgaggaguacauccuggagaaggugaaggacaaggagauccucaagaagggcgacaaccagaacuucaaguacuacauccugaacggccugcucaagcagcugaagaacgaggacgucgaguccuacaagguguucaaccugaacaccgagcccgaggacgugaacaucaaccagcucaagcaggaggccaccgaccuggagcagaaggcguucguccugacguacaucgccaacaaguucgccgccaaccagcuccccaagaaggaguucugggacuacugccaggagaaguacgggaagaucgagaaggagaagaccuacgccgaguacuucgcggagguguucaagaaggagaaggaggcccugaucaaguga

SEQ ID NO: 11166 - RNA, 3384 nt, Artificial Sequence
  Cas13b variant__Prevotella buccae__WP_004343973.1__Cas13b
augcagaagcaggacaagcuguucguggaccgcaagaagaacgccaucuucgccuuccccaaguacaucaccaucauggagaacaaggagaagccggagcccaucuacuacgagcucaccgacaagcacuucugggcggccuuccugaaccuggcccggcacaacgucuacacgaccaucaaccacaucaaccgccggcucgagaucgccgagcugaaggacgacggcuacaugauggggaucaagggcagcuggaacgagcaggccaagaagcuggacaagaaggugcgccuccgggaccugaucaugaagcacuuccccuuccuggaggcggccgccuacgagaugaccaacagcaagagccccaacaacaaggagcagcgcgagaaggagcaguccgaggcccucagccugaacaaccugaagaacgugcuguucaucuuccuggagaagcugcagguccuccggaacuacuacucccacuacaaguacagcgaggaguccccgaagcccaucuucgagaccagccugcugaagaacauguacaagguguucgacgcgaacgugcgccucgucaagcgggacuacaugcaccacgagaacaucgacaugcagcgcgacuucacgcaccugaaccggaagaagcaggucgggcgcaccaagaacaucaucgacucccccaacuuccacuaccacuucgccgacaaggagggcaacaugaccaucgccgggcugcuguucuucgugagccuguuccuggacaagaaggacgccaucuggaugcagaagaagcucaagggcuucaaggacggccggaaccugcgcgagcagaugaccaacgagguguucugccggucccgcaucagccugcccaagcucaagcuggagaacgugcagacgaaggacuggaugcagcuggacaugcucaacgagcuggugcggugcccgaagucccuguacgagcgccuccgggagaaggaccgcgagagcuucaagguccccuucgacaucuucuccgacgacuacaacgccgaggaggagcccuucaagaacacccuggugcggcaccaggaccgcuuccccuacuucgugcugcgcuacuucgaccucaacgagaucuucgagcagcugcgguuccagaucgaccuggggaccuaccacuucagcaucuacaacaagcgcaucggcgacgaggacgagguccggcaccucacccaccaccuguacggguucgcgcgcauccaggacuucgccccgcagaaccagcccgaggaguggcggaagcuggugaaggaccucgaccacuucgagacgucccaggagcccuacaucagcaagaccgcgccccacuaccaccuggagaacgagaagaucggcaucaaguucugcuccgcccacaacaaccuguucccgagccuccagaccgacaagaccugcaacgggcgcagcaaguucaaccugggcacgcaguucaccgccgaggccuuccuguccgugcacgagcuccugcccaugauguucuacuaccugcugcucaccaaggacuacagccggaaggaguccgccgacaaggucgagggcaucauccgcaaggagaucagcaacaucuacgccaucuacgacgccuucgccaacaacgagaucaacuccaucgcggaccugacccggcgccugcagaacacgaacauccuccaggggcaccuccccaagcagaugaucagcauccugaagggccggcagaaggacauggggaaggaggccgagcgcaagaucggcgagaugaucgacgacacccagcggcgccucgaccugcugugcaagcagaccaaccagaagauccggaucggcaagcgcaacgccgggcuccugaaguccggcaagaucgccgacuggcuggugaacgacaugaugcgguuccagcccgugcagaaggaccagaacaacaucccgaucaacaacagcaaggccaacuccaccgaguaccgcaugcuccagcgggcgcuggcccuguucgggagcgagaacuuccgccucaaggccuacuucaaccagaugaaccuggucggcaacgacaacccccaccccuuccuggccgagacgcagugggagcaccagaccaacauccucuccuucuaccgcaacuaccuggaggcgcggaagaaguaccugaaggggcucaagccccagaacuggaagcaguaccagcacuuccugauccugaaggugcagaagaccaaccgcaacacccucgugacgggcuggaagaacagcuucaaccugccgcggggcaucuucacccagcccauccgcgagugguucgagaagcacaacaacuccaagcggaucuacgaccagauccugagcuucgaccgcgucggguucguggccaaggccaucccccucuacuucgccgaggaguacaaggacaacguccagcccuucuacgacuacccguucaacaucggcaaccggcugaagcccaagaagcgccaguuccuggacaagaaggagcggguggagcucuggcagaagaacaaggagcuguucaagaacuaccccuccgagaagaagaagaccgaccuggccuaccucgacuuccugagcuggaagaaguucgagcgcgagcugcggcucaucaagaaccaggacaucgugaccuggcugauguucaaggagcuguucaacauggcgacggucgaggggcucaagaucggcgagauccaccuccgcgacaucgacaccaacaccgccaacgaggaguccaacaacauccugaaccggaucaugccgaugaagcuccccgugaagaccuacgagacggacaacaaggggaacauccugaaggagcgcccccuggccaccuucuacaucgaggagaccgagaccaaggugcucaagcagggcaacuucaaggcccuggucaaggaccggcgccugaacggccucuucagcuucgccgagaccacggaccugaaccuggaggagcaccccaucuccaagcucagcguggaccuggagcugaucaaguaccagaccacccggaucagcaucuucgagaugacccucgggcuggagaagaagcugaucgacaaguacuccacgcucccgaccgacagcuuccgcaacaugcuggagcgguggcugcagugcaaggcgaaccgccccgagcucaagaacuacgugaacucccugaucgccguccggaacgccuucagccacaaccaguaccccauguacgacgccacccuguucgccgaggugaagaaguucacccucuuccccuccguggacacgaagaagaucgagcugaacaucgcgccgcagcugcucgagaucgucggcaaggccaucaaggagaucgagaaguccgagaacaagaacuga

SEQ ID NO: 11167 - RNA, 3273 nt, Artificial Sequence
  Cas13b variant__Prevotella sp.__WP_044065294__Cas13b
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccugaccaaccacuacaagaccuacgaggagaagcucaacgacgggugcgaguuccugaccuccacggagcagccccugagcggcaugaucaacaacuacuacaccguggcgcuccggaacaugaacgagcgcuacggcuacaagaccgaggaccuggccuucauccaggacaagcgguucaaguucgucaaggacgccuacgggaagaagaagucccaggugaacaccggcuucuuccugagccuccaggacuacaacggggacacgcagaagaagcugcaccuguccggcguggggaucgcccuccugaucugccuguuccucgacaagcaguacaucaacaucuuccugagccgccugccgaucuucuccagcuacaacgcgcaguccgaggagcggcgcaucaucauccggagcuucggcaucaacuccaucaagcuccccaaggaccgcauccacagcgagaaguccaacaagagcgucgccauggacaugcugaacgaggugaagcggugccccgacgagcuguucaccacccucuccgccgagaagcagagccgcuuccggaucaucagcgacgaccacaacgaggugcugaugaagcgcuccagcgaccgguucgucccccugcuccugcaguacaucgacuacggcaagcuguucgaccacauccgcuuccacgugaacauggggaagcuccgguaccugcugaaggccgacaagaccugcaucgacggccagacgcgcgugcgggucaucgagcagccgcucaacggguucggccgccuggaggaggccgagaccaugcgcaagcaggagaacggcaccuucgggaacuccggcauccggauccgcgacuucgagaacaugaagcgggacgacgcgaaccccgccaacuaccccuacaucguggacaccuacacgcacuacauccuggagaacaacaagguggagauguucaucaacgacaaggaggacagcgcgccccuccugccggucaucgaggacgaccgcuacguggugaagaccauccccuccugccggaugagcacccuggagauccccgccauggccuuccacauguuccucuucggguccaagaagaccgagaagcugaucgucgacgugcacaaccgcuacaagcggcuguuccaggccaugcagaaggaggaggucacggccgagaacaucgccagcuucggcaucgccgaguccgaccucccccagaagauccuggaccugaucagcgggaacgcccacggcaaggacguggacgcguucauccgccucaccguggacgacaugcugaccgacaccgagcggcgcaucaagcgguucaaggacgaccgcaaguccauccggagcgccgacaacaagaugggcaagcgcggguucaagcagaucuccacgggcaagcuggccgacuuccuggccaaggacaucguccucuuccagccgagcgugaacgacggggagaacaagaucaccggccugaacuaccggaucaugcaguccgccaucgcgguguacgacagcggggacgacuacgaggccaagcagcaguucaagcugauguucgagaaggcccgccucaucggcaagggcaccaccgagccccaccccuuccuguacaaggucuucgcccgguccauccccgcgaacgccguggaguucuacgagcgcuaccugaucgagcggaaguucuaccucacggggcugagcaacgagaucaagaagggcaaccgcguggacgucccguucauccgccgggaccagaacaaguggaagacccccgccaugaagacccuggggcgcaucuacuccgaggaccuccccguggagcugccccggcagauguucgacaacgagaucaagagccaccucaagagccucccgcagauggagggcaucgacuucaacaacgccaacgugaccuaccugaucgccgaguacaugaagcgcguccuggacgacgacuuccagacguucuaccaguggaaccggaacuaccgcuacauggacaugcucaagggggaguacgaccggaagggcucccugcagcacugcuucaccagcguggaggagcgcgagggccuguggaaggagcgggcgucccgcaccgagcgguaccgcaagcaggccagcaacaagauccgguccaaccgccagaugcggaacgccagcuccgaggagaucgagaccauccucgacaagcgccugagcaacucccggaacgaguaccagaaguccgagaaggugauccgccgguaccgcguccaggacgcccugcuguuccugcuggccaagaagacgcucaccgagcuggcggacuucgacggggagcgguucaagcugaaggagaucaugcccgacgccgagaagggcauccucagcgagaucaugcccaugagcuucaccuucgagaagggcgggaagaaguacaccaucaccuccgagggcaugaagcugaagaacuacggggacuucuucgugcuggccagcgacaagcgcaucggcaaccuccuggagcuggugggguccgacaucgucagcaaggaggacaucauggaggaguucaacaaguacgaccagugccgccccgagaucuccagcaucguguucaaccucgagaagugggccuucgacacguacccggagcugagcgcccggguggaccgcgaggagaaggucgacuucaaguccauccugaagauccuccugaacaacaagaacaucaacaaggagcagagcgacauccugcggaagauccgcaacgcguucgaccacaacaacuaccccgacaagggcgugguggagaucaaggcccuccccgagaucgccauguccaucaagaaggccuucggggaguacgcgaucaugaaguga

SEQ ID NO: 11168 - RNA, 4152 nt, Artificial Sequence
  Cas13b variant__Artificial____PspCas13b-GS-HsADAR2DD(E488Q,del984-1090)
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccugaccaacgcguacaagaccuacgaggagaagcucaacgacgggugcgaguuccugaccuccacggagcagccccugagcggcaugaucaacaacuacuacaccguggcccuccggaacaugaacgagcgcuacggcuacaagaccgaggaccuggccuucauccaggacaagcgguucaaguucgucaaggacgccuacgggaagaagaagucccaggugaacaccggcuucuuccugagccuccaggacuacaacggggacacgcagaagaagcugcaccuguccggcguggggaucgcgcuccugaucugccuguuccucgacaagcaguacaucaacaucuuccugagccgccugccgaucuucuccagcuacaacgcccaguccgaggagcggcgcaucaucauccggagcuucggcaucaacuccaucaagcuccccaaggaccgcauccacagcgagaaguccaacaagagcgucgccauggacaugcugaacgaggugaagcggugccccgacgagcuguucaccacccucuccgccgagaagcagagccgcuuccggaucaucagcgacgaccacaacgaggugcugaugaagcgcuccagcgaccgguucgucccccugcuccugcaguacaucgacuacggcaagcuguucgaccacauccgcuuccacgugaacauggggaagcuccgguaccugcugaaggccgacaagaccugcaucgacggccagacgcgcgugcgggucaucgagcagccgcucaacggguucggccgccuggaggaggcggagaccaugcgcaagcaggagaacggcaccuucgggaacuccggcauccggauccgcgacuucgagaacaugaagcgggacgacgccaaccccgccaacuaccccuacaucguggacaccuacacgcacuacauccuggagaacaacaagguggagauguucaucaacgacaaggaggacagcgcgccccuccugccggucaucgaggacgaccgcuacguggugaagaccauccccuccugccggaugagcacccuggagauccccgccauggccuuccacauguuccucuucggguccaagaagaccgagaagcugaucgucgacgugcacaaccgcuacaagcggcuguuccaggccaugcagaaggaggaggucacggccgagaacaucgccagcuucggcaucgccgaguccgaccucccccagaagauccuggaccugaucagcgggaacgcgcacggcaaggacguggacgccuucauccgccucaccguggacgacaugcugaccgacaccgagcggcgcaucaagcgguucaaggacgaccgcaaguccauccggagcgccgacaacaagaugggcaagcgcggguucaagcagaucuccacgggcaagcuggccgacuuccuggccaaggacaucguccucuuccagccgagcgugaacgacggggagaacaagaucaccggccugaacuaccggaucaugcaguccgcgaucgccguguacgacagcggggacgacuacgaggccaagcagcaguucaagcugauguucgagaaggcccgccucaucggcaagggcaccaccgagccccaccccuuccuguacaaggucuucgcgcgguccauccccgccaacgccguggaguucuacgagcgcuaccugaucgagcggaaguucuaccucacggggcugagcaacgagaucaagaagggcaaccgcguggacgucccguucauccgccgggaccagaacaaguggaagacccccgccaugaagacccuggggcgcaucuacuccgaggaccuccccguggagcugccccggcagauguucgacaacgagaucaagagccaccucaagagccucccgcagauggagggcaucgacuucaacaacgccaacgugaccuaccugaucgcggaguacaugaagcgcguccuggacgacgacuuccagacguucuaccaguggaaccggaacuaccgcuacauggacaugcucaagggggaguacgaccggaagggcucccugcagcacugcuucaccagcguggaggagcgcgagggccuguggaaggagcgggccucccgcaccgagcgguaccgcaagcaggccagcaacaagauccgguccaaccgccagaugcggaacgccagcuccgaggagaucgagaccauccucgacaagcgccugagcaacucccggaacgaguaccagaaguccgagaaggugauccgccgguaccgcguccaggacgcccugcuguuccugcuggcgaagaagacgcucaccgagcuggccgacuucgacggggagcgguucaagcugaaggagaucaugcccgacgccgagaagggcauccucagcgagaucaugcccaugagcuucaccuucgagaagggcgggaagaaguacaccaucaccuccgagggcaugaagcugaagaacuacggggacuucuucgugcuggccagcgacaagcgcaucggcaaccuccuggagcuggugggguccgacaucgucagcaaggaggacggcucccuccagcugcccccgcuggagcgccucacgcuggggagccagcugcaccucccccaggugcuggccgacgcggugagccggcugguccucggcaaguucggcgaccugaccgacaacuucuccagcccccacgcccgccggaaggugcuggccgggguggucaugaccaccggcacggacgugaaggacgccaaggugaucuccgucagcaccgggaccaagugcaucaacggcgaguacauguccgaccgcgggcucgcgcugaacgacugccacgccgagaucaucagccggcgcucccugcuccgguuccuguacacccagcuggagcucuaccugaacaacaaggacgaccagaagcgcagcaucuuccagaaguccgagcggggcggcuuccgccugaaggagaacgugcaguuccaccucuacaucagcacguccccgugcggggacgcccggaucuucagcccccacgagcccauccuggaggagcccgccgaccgccacccgaaccggaaggcccgcggccagcugcggaccaagaucgaguccgggcagggcaccauccccgugcgcagcaacgcguccauccagaccugggacgggguccuccagggcgagcggcugcugacgaugagcugcuccgacaagaucgcccgcuggaacguggugggcauccaggggagccuccuguccaucuucgucgagcccaucuacuucagcagcaucauccugggcucccucuaccacggggaccaccugagccgggccauguaccagcgcaucuccaacaucgaggaccugcccccgcucuacacccugaacaagccccugcucagcggcaucuccaacgccgaggcccgccagcccgggaaggcgcccaacuucagcgugaacuggaccgugggcgacuccgccaucgaggucaucaacgccaccacgggcaaggacgagcuggggcgggccagccgccugugcaagcacgcccucuacugccgguggaugcgcgugcacggcaaggugccgucccaccuccugcggagcaagaucaccaagcccaacgucuaccacgaguccaagcuggcggccaaggaguaccaggccgccaaggcgcgccuguucaccgccuucaucaaggccgggcugggcgccuggguggagaagcccaccgagcaggaccaguucagccucacguga

SEQ ID NO: 11169 - RNA, 4152 nt, Artificial Sequence
  Cas13b variant__Artificial____PspCas13b-GS-HsADAR2DD(E488Q,T375G,del984- 1090)
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccugaccaacgcguacaagaccuacgaggagaagcucaacgacgggugcgaguuccugaccuccacggagcagccccugagcggcaugaucaacaacuacuacaccguggcccuccggaacaugaacgagcgcuacggcuacaagaccgaggaccuggccuucauccaggacaagcgguucaaguucgucaaggacgccuacgggaagaagaagucccaggugaacaccggcuucuuccugagccuccaggacuacaacggggacacgcagaagaagcugcaccuguccggcguggggaucgcgcuccugaucugccuguuccucgacaagcaguacaucaacaucuuccugagccgccugccgaucuucuccagcuacaacgcccaguccgaggagcggcgcaucaucauccggagcuucggcaucaacuccaucaagcuccccaaggaccgcauccacagcgagaaguccaacaagagcgucgccauggacaugcugaacgaggugaagcggugccccgacgagcuguucaccacccucuccgccgagaagcagagccgcuuccggaucaucagcgacgaccacaacgaggugcugaugaagcgcuccagcgaccgguucgucccccugcuccugcaguacaucgacuacggcaagcuguucgaccacauccgcuuccacgugaacauggggaagcuccgguaccugcugaaggccgacaagaccugcaucgacggccagacgcgcgugcgggucaucgagcagccgcucaacggguucggccgccuggaggaggcggagaccaugcgcaagcaggagaacggcaccuucgggaacuccggcauccggauccgcgacuucgagaacaugaagcgggacgacgccaaccccgccaacuaccccuacaucguggacaccuacacgcacuacauccuggagaacaacaagguggagauguucaucaacgacaaggaggacagcgcgccccuccugccggucaucgaggacgaccgcuacguggugaagaccauccccuccugccggaugagcacccuggagauccccgccauggccuuccacauguuccucuucggguccaagaagaccgagaagcugaucgucgacgugcacaaccgcuacaagcggcuguuccaggccaugcagaaggaggaggucacggccgagaacaucgccagcuucggcaucgccgaguccgaccucccccagaagauccuggaccugaucagcgggaacgcgcacggcaaggacguggacgccuucauccgccucaccguggacgacaugcugaccgacaccgagcggcgcaucaagcgguucaaggacgaccgcaaguccauccggagcgccgacaacaagaugggcaagcgcggguucaagcagaucuccacgggcaagcuggccgacuuccuggccaaggacaucguccucuuccagccgagcgugaacgacggggagaacaagaucaccggccugaacuaccggaucaugcaguccgcgaucgccguguacgacagcggggacgacuacgaggccaagcagcaguucaagcugauguucgagaaggcccgccucaucggcaagggcaccaccgagccccaccccuuccuguacaaggucuucgcgcgguccauccccgccaacgccguggaguucuacgagcgcuaccugaucgagcggaaguucuaccucacggggcugagcaacgagaucaagaagggcaaccgcguggacgucccguucauccgccgggaccagaacaaguggaagacccccgccaugaagacccuggggcgcaucuacuccgaggaccuccccguggagcugccccggcagauguucgacaacgagaucaagagccaccucaagagccucccgcagauggagggcaucgacuucaacaacgccaacgugaccuaccugaucgcggaguacaugaagcgcguccuggacgacgacuuccagacguucuaccaguggaaccggaacuaccgcuacauggacaugcucaagggggaguacgaccggaagggcucccugcagcacugcuucaccagcguggaggagcgcgagggccuguggaaggagcgggccucccgcaccgagcgguaccgcaagcaggccagcaacaagauccgguccaaccgccagaugcggaacgccagcuccgaggagaucgagaccauccucgacaagcgccugagcaacucccggaacgaguaccagaaguccgagaaggugauccgccgguaccgcguccaggacgcccugcuguuccugcuggcgaagaagacgcucaccgagcuggccgacuucgacggggagcgguucaagcugaaggagaucaugcccgacgccgagaagggcauccucagcgagaucaugcccaugagcuucaccuucgagaagggcgggaagaaguacaccaucaccuccgagggcaugaagcugaagaacuacggggacuucuucgugcuggccagcgacaagcgcaucggcaaccuccuggagcuggugggguccgacaucgucagcaaggaggacggcucccuccagcugcccccgcuggagcgccucacgcuggggagccagcugcaccucccccaggugcuggccgacgcggugagccggcugguccucggcaaguucggcgaccugaccgacaacuucuccagcccccacgcccgccggaaggugcuggccgggguggucaugaccaccggcacggacgugaaggacgccaaggugaucuccgucagcaccgggggcaagugcaucaacggggaguacauguccgaccgcggccucgcgcugaacgacugccacgccgagaucaucagccggcgcucccugcuccgguuccuguacacccagcuggagcucuaccugaacaacaaggacgaccagaagcgcagcaucuuccagaaguccgagcggggcggguuccgccugaaggagaacgugcaguuccaccucuacaucagcaccuccccgugcggcgacgcccggaucuucagcccccacgagcccauccuggaggagcccgccgaccgccacccgaaccggaaggcccgcgggcagcugcggacgaagaucgaguccggccaggggaccauccccgugcgcagcaacgcguccauccagaccugggacggcguccuccagggcgagcggcugcugaccaugagcugcuccgacaagaucgcccgcuggaacgugguggggauccagggcagccuccuguccaucuucgucgagcccaucuacuucagcagcaucauccuggggucccucuaccacggcgaccaccugagccgggccauguaccagcgcaucuccaacaucgaggaccugcccccgcucuacacgcugaacaagccccugcucagcgggaucuccaacgccgaggcccgccagcccggcaaggcgcccaacuucagcgugaacuggaccgugggcgacuccgccaucgaggucaucaacgccaccaccgggaaggacgagcugggccgggccagccgccugugcaagcacgcccucuacugccgguggaugcgcgugcacgggaaggugccgucccaccuccugcggagcaagaucacgaagcccaacgucuaccacgaguccaagcuggcggccaaggaguaccaggccgccaaggcgcgccuguucaccgccuucaucaaggccggccugggcgccuggguggagaagcccaccgagcaggaccaguucagccucaccuga

SEQ ID NO: 11170 - RNA, 2862 nt, Artificial Sequence
  Cas13b variant__Alistipes sp.__WP_047447901.1__Cas13b
augagcaacgagaucggcgccuuccgcgagcaccaguucgccuacgcgcccgggaacgagaagcaggaggaggccaccuucgccaccuacuucaaccuggcccucuccaacguggagggcaugauguucggggaggucgagagcaacccggacaagaucgagaagucccuggacacgcugccgcccgccauccuccggcagaucgcgagcuucaucuggcuguccaaggaggaccaccccgacaaggccuacagcaccgaggaggugaaggugaucgucaccgaccuggugcgccggcucugcuucuaccgcaacuacuucucccacugcuucuaccuggacacccaguacuucuacagcgacgagcugguggacacgaccgccaucggcgagaagcuccccuacaacuuccaccacuucaucaccaaccggcuguuccgcuacucccugcccgagaucacccucuuccgguggaacgagggggagcgcaaguacgagauccugcgggacggccugaucuucuucugcugccucuuccugaagcgcggccaggccgagcgguuccugaacgagcuccgcuucuucaagcggacggacgaggaggggcgcaucaagcggaccaucuucaccaaguacugcacccgcgagagccacaagcacaucggcaucgaggagcaggacuuccugaucuuccaggacaucaucggggaccugaaccggguccccaaggugugcgacggcguggucgaccucuccaaggagaacgagcgcuacaucaagaaccgggagacgagcaacgaguccgacgagaacaaggcgcgcuaccggcugcugauccgcgagaaggacaaguuccccuacuaccucaugcgcuacaucguggacuucggggugcugccgugcaucaccuucaagcagaacgacuacagcaccaaggagggccggggccaguuccacuaccaggacgccgccgucgcccaggaggagcgcugcuacaacuucguggugcggaacgggaacgucuacuacuccuacaugccccaggcccagaacguggugcgcaucagcgagcugcagggcaccaucuccgucgaggagcuccggaacaugguguacgcgagcaucaacgggaaggacgugaacaaguccgucgagcaguaccuguaccaccuccaccuccuguacgagaagauccugacgaucagcggccagaccaucaaggagggccgcguggacguggaggacuaccggccccugcuggacaagcugcuccugcgccccgccagcaacggggaggagcugcggcgcgagcuccggaagcugcugccgaagcgcgucugcgaccuccuguccaaccgguucgacugcagcgagggcguguccgccgucgagaagcgccugaaggccauccuccugcggcacgagcagcugcuccugagccagaaccccgcccugcacaucgacaagaucaaguccgugaucgacuaccuguaccucuucuucagcgacgacgagaaguuccgccagcagcccaccgagaaggcgcaccgggggcugaaggacgaggaguuccagauguaccacuaccuggugggcgacuacgacucccacccccucgcccuguggaaggagcuggaggccagcgggcgccucaagccggagaugcggaagcugaccuccgccacgagccugcacggccucuacaugcugugccugaagggcaccgucgaguggugccgcaagcagcucauguccaucgggaagggcaccgccaagguggaggcgaucgccgaccgcguggggcugaagcuguacgacaagcucaaggaguacacccccgagcagcuggagcgggaggucaagcugguggugaugcacggcuacgccgccgccgcgacgcccaagcccaaggcccaggccgccaucccgagcaagcucaccgagcugcgcuucuacuccuuccuggggaagcgggagaugagcuucgcggccuucauccgccaggacaagaaggcccagaagcucuggcugcggaacuucuacaccgucgagaacaucaagacccugcagaagcgccaggccgccgcggacgccgccugcaagaagcucuacaaccuggugggcgagguggagcggguccacacgaacgacaaggugcuggugcucgucgcccagcgcuaccgggagcgccugcugaacgugggcuccaagugcgccgugacccucgacaaccccgagcggcagcagaagcuggcggacgucuacgaggugcagaacgccuggcugagcauccgcuucgacgaccucgacuucacccugacccacgugaaccuguccaaccuccggaaggccuacaaccugaucccccgcaagcacauccuggccuucaaggaguaccucgacaaccgggucaagcagaagcugugcgaggagugccgcaacgugcggcgcaaggaggaccugugcacgugcugcagcccccgguacuccaaccucaccagcuggcugaaggagaaccacagcgaguccagcaucgagcgcgaggccgcgaccaugaugcugcucgacguggagcggaagcugcuguccuuccuccuggacgagcgccgcaaggccaucaucgaguacgggaaguucaucccguucagcgcccuggucaaggagugccggcucgccgacgcgggccugugcgggauccgcaacgacgugcugcacgacaacgugaucuccuacgccgacgccaucggcaagcucagcgccuacuuccccaaggaggccuccgaggcggucgaguacauccggcgcaccaaggaggugcgggagcagcgccgggaggagcugauggccaacagcucccaguga

SEQ ID NO: 11171 - RNA, 3348 nt, Artificial Sequence
  Cas13b variant__Bacteroides pyogenes__ERI81700.1__Cas13b
auggagagcaucaagaacucccagaaguccaccggcaagacccugcagaaggacccgcccuacuucgggcucuaccugaacauggcccugcucaacgugcgcaaggucgagaaccacauccggaaguggcugggcgacguggcccugcuccccgagaaguccggguuccacagccugcugacgaccgacaaccucagcagcgcgaaguggacccgcuucuacuacaagucccggaaguuccugcccuuccuggagauguucgacagcgacaagaaguccuacgagaaccgccgggagaccacggagugccucgacaccaucgaccgccagaagaucagcucccugcugaaggagguguacggcaagcuccaggacauccggaacgccuucagccacuaccacaucgacgaccaguccgucaagcacaccgcccugaucaucagcuccgagaugcaccgcuucaucgagaacgccuacagcuucgcccugcagaagacccgggcgcgcuucacggggguguucguggagaccgacuuccuccaggccgaggagaagggcgacaacaagaaguucuucgccaucggcgggaacgagggcaucaagcugaaggacaacgcccugaucuuccucaucugccuguuccuggaccgggaggaggcguucaaguuccucucccgcgccaccggguucaagagcaccaaggagaagggcuuccuggccguccgggagacguucugcgcccugugcugccgccagccccacgagcggcuccuguccgugaacccgcgcgaggcccugcucauggacaugcugaacgagcugaaccggugccccgacauccucuucgagaugcuggacgagaaggaccagaaguccuuccugccccuccugggggaggaggagcaggcgcacauccuggagaacagccucaacgacgagcugugcgaggccaucgacgaccccuucgagaugaucgccagccugagcaagcgcgugcgguacaagaaccgcuucccguaccucaugcugcgguacaucgaggagaagaaccugcuccccuucauccgcuuccgcaucgaccugggcugccuggagcucgccuccuaccccaagaagaugggcgaggagaacaacuacgagcggagcgucaccgaccacgccauggcguucgggcgccugaccgacuuccacaacgaggacgccgugcugcagcagaucaccaagggcaucacggacgaggugcgguucucccuguacgcgccccgcuacgccaucuacaacaacaagaucggguucguccggaccggcggcagcgacaagaucuccuucccgacccucaagaagaagggcggggaggggcacugcguggccuacacccugcagaacaccaagagcuucggcuucaucuccaucuacgaccugcgcaagauccuccugcugagcuuccucgacaaggacaaggccaagaacaucguguccgggcugcuggagcagugcgagaagcacuggaaggaccucagcgagaaccuguucgacgccauccggacggagcugcagaaggaguuccccgucccccucauccgcuacacccugccccgguccaagggcggcaagcuggugagcuccaagcucgccgacaagcaggagaaguacgagagcgaguucgagcgccggaaggagaagcugaccgagauccuguccgagaaggacuucgaccucagccagaucccgcgccggaugaucgacgaguggcugaacgugcugcccacgucccgcgagaagaagcucaagggguacgucgagacccugaagcuggacugccgggagcgccuccggguguucgagaagcgcgagaagggcgagcaccccgugcccccgcggaucggggagauggccaccgaccuggccaaggacaucauccgcauggucaucgaccagggcgugaagcagcgcaucaccagcgcguacuacagcgagauccagcggugccuggcccaguacgccggggacgacaaccgccggcaccucgacuccaucauccgcgagcugcggcugaaggacacgaagaacggccaccccuuccucggcaaggugcugcgccccgggcugggccacaccgagaagcucuaccagcgguacuucgaggagaagaaggaguggcuggaggccaccuucuaccccgcggccagcccgaagcgcgucccccgguucgugaacccgcccaccgggaagcagaaggagcugccccucaucauccgcaaccugaugaaggagcggcccgaguggcgcgacuggaagcagcggaagaacucccaccccaucgaccugccgagccagcuguucgagaacgagaucugccgccuccugaaggacaagaucggcaaggagcccuccgggaagcucaaguggaacgagauguucaagcuguacugggacaaggaguuccccaacggcaugcagcgguucuaccgcugcaagcggcgcgucgagguguucgacaagguggucgaguacgaguacagcgaggagggcgggaacuacaagaaguacuacgaggcccugaucgacgagguggugcggcagaagaucuccagcuccaaggagaaguccaagcuccaggucgaggaccugacgcugagcgugcgccggguguucaagcgcgccaucaacgagaaggaguaccagcuccgccugcugugcgaggacgaccggcuccuguucauggccguccgcgaccuguacgacuggaaggaggcgcagcucgaccuggacaagaucgacaacaugcugggcgagcccgugagcgugucccaggucauccagcucgagggcgggcagccggacgccgugaucaaggccgagugcaagcugaaggacgugagcaagcugaugcgguacugcuacgacggccgcgucaaggggcucaugcccuacuucgccaaccacgaggccacccaggagcaggucgagauggagcugcggcacuacgaggaccaccgccggcgcguguucaacuggguguucgcgcuggagaaguccgugcucaagaacgagaagcugcggcgcuucuacgaggagagccagggcgggugcgagcaccggcgcugcaucgacgcccugcggaaggccucccucgugagcgaggaggaguacgaguuccugguccacauccgcaacaagagcgcccacaaccaguuccccgaccuggagaucggcaagcugcccccgaacgugaccuccggguucugcgagugcaucuggagcaaguacaaggccaucaucugccggaucauccccuucaucgaccccgagcgccgguucuucggcaagcuccuggagcagaaguga

SEQ ID NO: 11172 - RNA, 3348 nt, Artificial Sequence
  Cas13b variant__Bacteroides pyogenes__WP_034542281.1__Cas13b
auggagagcaucaagaacucccagaaguccaccggcaagacccugcagaaggacccgcccuacuucgggcucuaccugaacauggcccugcucaacgugcgcaaggucgagaaccacauccggaaguggcugggcgacguggcccugcuccccgagaaguccggguuccacagccugcugacgaccgacaaccucagcagcgcgaaguggacccgcuucuacuacaagucccggaaguuccugcccuuccuggagauguucgacagcgacaagaaguccuacgagaaccgccgggagaccgccgagugccucgacacgaucgaccgccagaagaucagcucccugcugaaggagguguacggcaagcuccaggacauccggaacgccuucagccacuaccacaucgacgaccaguccgucaagcacaccgcccugaucaucagcuccgagaugcaccgcuucaucgagaacgccuacagcuucgcgcugcagaagacccgggcccgcuucaccgggguguucguggagacggacuuccuccaggccgaggagaagggcgacaacaagaaguucuucgccaucggcgggaacgagggcaucaagcugaaggacaacgcgcugaucuuccucaucugccuguuccuggaccgggaggaggccuucaaguuccucucccgcgccaccggguucaagagcaccaaggagaagggcuuccuggccguccgggagaccuucugcgcccugugcugccgccagccccacgagcggcuccuguccgugaacccgcgcgaggcgcugcucauggacaugcugaacgagcugaaccggugccccgacauccucuucgagaugcuggacgagaaggaccagaaguccuuccugccccuccugggggaggaggagcaggcccacauccuggagaacagccucaacgacgagcugugcgaggccaucgacgaccccuucgagaugaucgccagccugagcaagcgcgugcgguacaagaaccgcuucccguaccucaugcugcgguacaucgaggagaagaaccugcuccccuucauccgcuuccgcaucgaccugggcugccuggagcucgccuccuaccccaagaagaugggcgaggagaacaacuacgagcggagcgucacggaccacgcgauggccuucgggcgccugaccgacuuccacaacgaggacgccgugcugcagcagaucaccaagggcaucaccgacgaggugcgguucucccuguacgcgccccgcuacgccaucuacaacaacaagaucggguucguccggacgagcggcuccgacaagaucagcuucccgacccucaagaagaagggcggggagggccacugcguggccuacacccugcagaacaccaaguccuucggguucaucagcaucuacgaccugcgcaagauccuccugcuguccuuccucgacaaggacaaggccaagaacaucgugagcggccugcuggagcagugcgagaagcacuggaaggaccucuccgagaaccuguucgacgccauccggacggagcugcagaaggaguuccccgucccccucauccgcuacacccugccccggagcaagggcgggaagcugguguccagcaagcucgccgacaagcaggagaaguacgaguccgaguucgagcgccggaaggagaagcugaccgagauccugagcgagaaggacuucgaccucucccagaucccgcgccggaugaucgacgaguggcugaacgugcugcccaccagccgcgagaagaagcucaagggcuacgucgagacgcugaagcuggacugccgggagcgccuccggguguucgagaagcgcgagaagggggagcacccccugcccccgcggaucggcgagauggccaccgaccuggcgaaggacaucauccgcauggugaucgaccagggggucaagcagcgcaucaccagcgccuacuacuccgagauccagcggugccucgcccaguacgccggcgacgacaaccgccggcaccuggacagcaucauccgcgagcugcggcucaaggacaccaagaacgggcaccccuuccugggcaaggugcugcgccccggccucgggcacacggagaagcuguaccagcgguacuucgaggagaagaaggaguggcuggaggcgaccuucuaccccgccgccuccccgaagcgcgugccccgguucgucaacccgcccaccggcaagcagaaggagcucccccugaucauccgcaaccugaugaaggagcggcccgaguggcgcgacuggaagcagcggaagaacagccaccccaucgaccucccgucccagcuguucgagaacgagaucugccgccugcucaaggacaagaucgggaaggagcccagcggcaagcugaaguggaacgagauguucaagcuguacugggacaaggaguuccccaacgggaugcagcgguucuaccgcugcaagcggcgcguggaggucuucgacaaggugguggaguacgaguacuccgaggagggcggcaacuacaagaaguacuacgaggcccucaucgacgaggucgugcggcagaagaucagcuccagcaaggagaaguccaagcuccagguggaggaccugacccugagcguccgccggguguucaagcgcgccaucaacgagaaggaguaccagcugcgccugcucugcgaggacgaccggcugcuguucauggcggugcgcgaccucuacgacuggaaggaggcccagcuggaccuggacaagaucgacaacaugcucggggagcccgucuccgugagccaggugauccagcuggagggcgggcagccggacgccgucaucaaggccgagugcaagcugaaggacguguccaagcucaugcgguacugcuacgacggccgcgugaagggccugaugcccuacuucgccaaccacgaggcgacgcaggagcaggucgagauggagcugcggcacuacgaggaccaccgccggcgcguguucaacuggguguucgcccucgagaaguccguccugaagaacgagaagcugcggcgcuucuacgaggagagccagggcgggugcgagcaccggcgcugcaucgacgcccuccggaaggccagccuggugagcgaggaggaguacgaguuccuggugcacauccgcaacaaguccgcccacaaccaguuccccgaccucgagaucgggaagcugcccccgaacgucaccagcggcuucugcgagugcaucugguccaaguacaaggcgaucaucugccggaucauccccuucaucgaccccgagcgccgguucuucgggaagcugcucgagcagaaguga

SEQ ID NO: 11173 - RNA, 3675 nt, Artificial Sequence; identical to SEQ ID NO: 11164
  Cas13b variant__Bergeyella zoohelcum__WP_002664492.1__Cas13b

SEQ ID NO: 11174 - RNA, 3600 nt, Artificial Sequence
  Cas13b variant__Capnocytophaga canimorsus__WP_013997271.1__Cas13b
augaagaacauccagcgccugggcaaggggaacgaguucagccccuucaagaaggaggacaaguucuacuucggcggguuccucaaccuggccaacaacaacaucgaggacuucuucaaggagaucaucacccgguucggcaucgugaucaccgacgagaacaagaagccgaaggagacguucggggagaagauccugaacgagaucuucaagaaggacaucuccaucgucgacuacgagaagugggugaacaucuucgccgacuacuuccccuucaccaaguaccucagccuguaccuggaggagaugcaguucaagaaccgcgugaucugcuuccgggacgucaugaaggagcuccugaagaccguggaggcgcugcgcaacuucuacacccacuacgaccacgagcccaucaagaucgaggaccggguguucuacuuccucgacaagguccugcuggacgugucccucacggugaagaacaaguaccugaagaccgacaagaccaaggaguuccugaaccagcacaucggcgaggagcucaaggagcugugcaagcagcgcaaggacuaccuggucggcaaggggaagcggaucgacaaggagagcgagaucaucaacggcaucuacaacaacgccuucaaggacuucaucugcaagcgcgagaagcaggacgacaaggagaaccacaacuccguggagaagauccucugcaacaaggagccccagaacaagaagcagaaguccagcgccaccgugugggagcugugcagcaaguccagcuccaaguacacggagaaguccuucccgaaccgggagaacgacaagcacugccuggagguccccaucagccagaaggggaucguguuccuccugagcuucuuccugaacaagggcgagaucuacgcccucaccuccaacaucaagggguucaaggccaagaucaccaaggaggagcccgugaccuacgacaagaacagcauccgcuacauggcgacgcaccggauguucuccuuccuggccuacaagggccugaagcgcaagauccggaccagcgagaucaacuacaacgaggacggccaggccuccagcaccuacgagaaggagacccucaugcugcagaugcuggacgagcucaacaagguccccgacgugguguaccagaaccugagcgaggacguccagaagacguucaucgaggacuggaacgaguaccugaaggagaacaacggggacgugggcaccauggaggaggagcaggucauccacccggugauccgcaagcgguacgaggacaaguucaacuacuucgccauccgcuuccucgacgaguucgcgcaguuccccacccugcgguuccaggugcaccuggggaacuaccucugcgacaagcgcaccaagcagaucugcgacacgaccaccgagcgggaggugaagaagaagaucaccgucuucggccgccuguccgagcuggagaacaagaaggccaucuuccucaacgagcgggaggagaucaagggcugggagguguuccccaaccccagcuacgacuucccgaaggagaacaucuccgucaacuacaaggacuuccccaucguggggagcauccuggaccgcgagaagcagcccguguccaacaagaucggcauccgcgucaagaucgccgacgagcugcagcgggagaucgacaaggccaucaaggagaagaagcuccgcaaccccaagaaccggaaggccaaccaggacgagaagcagaaggagcgccuggugaacgagaucgugagcacgaacuccaacgagcagggggagccggucguguucaucggccagcccaccgcguaccugagcaugaacgacauccacuccgugcucuacgaguuccugaucaacaagaucagcggggaggcccuggagaccaagaucgucgagaagaucgagacccagaucaagcagaucaucggcaaggacgccacgaccaagauccucaagcccuacaccaacgccaacuccaacagcaucaaccgggagaagcugcugcgcgaccuggagcaggagcagcagauccucaagacccugcuggaggagcagcagcagcgggagaaggacaagaaggacaagaaguccaagcgcaagcacgagcucuaccccagcgagaagggcaagguggccguguggcuggcgaacgacaucaagcgguucaugccgaaggccuucaaggagcaguggcgcggguaccaccacucccugcuccagaaguaccuggccuacuacgagcagagcaaggaggagcugaagaaccuccugcccaaggaggucuucaagcacuuccccuucaagcugaagggcuacuuccagcagcaguaccucaaccaguucuacacggacuaccugaagcggcgccuguccuacgugaacgagcuccugcugaacauccagaacuucaagaacgacaaggacgcccucaaggccaccgagaaggagugcuucaaguucuuccggaagcagaacuacaucaucaaccccaucaacauccagauccagagcauccugguguacccgaucuuccugaagcgcggguuccucgacgagaagcccaccaugaucgaccgggagaaguucaaggagaacaaggacaccgagcuggcggacugguucaugcacuacaagaacuacaaggaggacaacuaccagaaguucuacgccuacccccuggagaaggucgaggagaaggagaaguucaagcgcaacaagcagaucaacaagcagaagaagaacgacguguacacgcucaugaugguggaguacaucauccagaagaucuucggcgacaaguucgucgaggagaacccccuggugcugaaggggaucuuccaguccaaggccgagcggcagcagaacaacacccacgccgccaccacccaggagcgcaaccucaacggcauccugaaccagccgaaggacaucaagauccagggcaagaucaccgugaagggggucaagcugaaggacaucggcaacuuccggaaguacgagaucgaccagcgcgugaacacguuccucgacuacgagccccgcaaggaguggauggcguaccugcccaacgacuggaaggagaaggagaagcaggggcagcugccgcccaacaacgugaucgaccggcagaucagcaaguacgagaccguccgcagcaagauccuccugaaggacgugcaggagcuggagaagaucaucuccgacgagaucaaggaggagcaccggcacgaccucaagcagggcaaguacuacaacuucaaguacuacauccugaacgggcugcuccgccagcugaagaacgagaacguggagaacuacaaggucuucaagcugaacaccaaccccgagaaggugaacaucacccagcucaagcaggaggccacggaccuggagcagaaggccuucgugcugaccuacauccggaacaaguucgcccacaaccagcuccccaagaaggaguucugggacuacugccaggagaaguacggcaagaucgagaaggagaagaccuacgcggaguacuucgccgaggucuucaagcgcgagaaggaggcccugaucaaguga

SEQ ID NO: 11175 - RNA, 3657 nt, Artificial Sequence
  Cas13b variant__Capnocytophaga cynodegmi__WP_041989581.1__Cas13b
auggagaacaagaccagccugggcaacaacaucuacuacaaccccuucaagccgcaggacaaguccuacuucgccggguaccucaacgccgcgauggagaacaucgacagcguguuccgcgagcugggcaagcggcugaaggggaaggaguacaccuccgagaacuucuucgacgccaucuucaaggagaacaucagccucgucgaguacgagcgcuacgugaagcugcuguccgacuacuuccccauggcccggcuccuggacaagaaggaggugcccaucaaggagcgcaaggagaacuucaagaagaacuuccggggcaucaucaaggccguccgcgaccugcggaacuucuacacgcacaaggagcacggggagguggagaucaccgacgagaucuucggcgugcucgacgagaugcucaagagcaccguccugaccgugaagaagaagaagaucaagacggacaagaccaaggagauccugaagaaguccaucgagaagcagcuggacauccugugccagaagaagcucgaguaccugaaggacaccgcccgcaagaucgaggagaagcggcgcaaccagcgggagcgcggcgagaagaagcuggugccccgguucgaguacagcgaccgccgggacgaccucaucgcggccaucuacaacgacgccuucgacgucuacaucgacaagaagaaggacucccugaaggagagcuccaagaccaaguacaacacggagagcuacccgcagcaggaggagggggaccugaagauccccaucuccaagaacggcgugguguuccuccugagccuguuccucuccaagcaggagguccacgccuucaagagcaagaucgcgggguucaaggccaccgugaucgacgaggccaccgugucccaccgcaagaacagcaucugcuucauggccacccacgagaucuucucccaccuggccuacaagaagcugaagcggaagguccgcacggcggagaucaacuacagcgaggccgagaacgccgagcagcucagcaucuacgccaaggagacccugaugaugcagaugcuggacgagcucuccaaggugcccgacguggucuaccagaaccugagcgaggacgugcagaagaccuucaucgaggacuggaacgaguaccugaaggagaacaacggcgacguggggaccauggaggaggagcaggucauccaccccgugauccggaagcgcuacgaggacaaguucaacuacuucgccauccgguuccucgacgaguucgcgcaguucccgacgcugcgcuuccaggugcaccugggcaacuaccuccacgacucccgccccaaggagcaccugaucagcgaccggcgcaucaaggagaagaucaccgucuucggccggcuguccgagcucgagcacaagaaggcccuguucaucaagaacaccgagaccaacgaggaccgcaagcacuacugggagguguuccccaaccccaacuacgacuucccgaaggagaacaucagcgucaacgacaaggacuuccccaucgccggguccauccuggaccgggagaagcagcccacggccggcaagaucgggaucaaggugaaccuccugaaccagaaguacaucagcgagguggacaaggccgucaaggcgcaccagcugaagcagcgcaacaacaagcccuccauccagaacaucaucgaggagaucgugccgaucaacggcagcaaccccaaggagaucaucguguucggcgggcagcccaccgccuaccucuccaugaacgacauccacagcauccuguacgaguucuucgacaagugggagaagaagaaggagaagcuggagaagaagggcgagaaggagcuccggaaggagaucgggaaggagcuggaggagaagaucgucggcaagauccagacccagauccagcagaucaucgacaaggacaucaacgccaagauccugaagcccuaccaggacgacgacuccaccgccaucgacaaggagaagcugaucaaggaccucaagcaggagcagaagauccugcagaagcugaagaacgagcagacggcccgcgagaaggaguaccaggagugcaucgcguaccaggaggagagccggaagaucaagcgcuccgacaagagccggcagaaguaccuccgcaaccagcugaagcggaaguacccggaggugcccacccgcaaggagauccuguacuaccaggagaaggggaagguggccgucuggcucgccaacgacaucaagcgguucaugcccaccgacuucaagaacgaguggaagggcgagcagcacucccugcugcagaagucccucgccuacuacgagcagugcaaggaggagcugaagaaccugcucccccagcagaagguguucaagcaccucccguucgagcugggcgggcacuuccagcagaaguaccuguaccaguucuacacccgcuaccuggacaagcggcuggagcacaucagcggccucgugcagcaggcggagaacuucaagaacgagaacaaggucuucaagaagguggagaacgagugcuucaaguuccugaagaagcagaacuacacgcacaaggggcuggacgcccaggcccagagcgugcucggcuaccccaucuuccuggagcgcggguucauggacgagaagcccaccaucaucaagggcaagaccuucaagggcaacgagagccuguucaccgacugguuccgguacuacaaggaguaccagaacuuccagacguucuacgacaccgagaacuacccccucgucgagcuggagaagaagcaggccgaccgcaagcgcgagaccaagaucuaccagcagaagaagaacgacguguucacccugcucauggccaagcacaucuucaaguccguguucaagcaggacagcaucgaccgguucucccuggaggaccuguaccagagccgcgaggagcggcucgagaaccaggagaaggcgaagcagacgggggagcgcaacaccaacuacaucuggaacaagaccgucgaccugaaccugugcgacggcaaggugaccguggagaacgucaagcucaagaacguggggaacuucaucaaguacgaguacgaccagcgggugcagaccuuccugaaguacgaggagaacaucaaguggcaggccuuccugaucaaggaguccaaggaggaggagaacuacccguacaucgucgagcgcgagaucgagcaguacgagaaggugcggcgcgaggagcuccugaaggaggugcaccugaucgaggaguacauccucgagaaggucaaggacaaggagauccugaagaagggcgacaaccagaacuucaaguacuacauccugaacgggcuccugaagcagcugaagaacgaggacguggagagcuacaagguguucaaccucaacacgaagcccgaggacgucaacaucaaccagcugaagcaggaggccaccgaccuggagcagaaggccuucgugcucaccuacauccggaacaaguucgcccacaaccagcugcccaagaaggaguucugggacuacugccaggagaaguacggcaagaucgagaaggagaagaccuacgcggaguacuucgccgagguguucaagcgcgagaaggaggcccugaugaaguga

SEQ ID NO: 11176 - RNA, 3438 nt, Artificial Sequence
  Cas13b variant__Chryseobacterium sp.__WP_047431796.1__Cas13b
auggagacccagaccaucggccacgggaucgccuacgaccacagcaagauccaggacaagcacuucuucggcggguuccugaaccucgccgagaacaacaucaaggcggugcugaaggccuucuccgagaaguucaacgucggcaacguggacgugaagcaguucgccgacgucagccugaaggacaaccuccccgacaacgacuuccagaagcgcguguccuuccugaagauguacuucccgguggucgacuucaucaacauccccaacaaccgggccaaguuccgcagcgaccugacgacccucuucaaguccguggaccagcugcggaacuucuacacccacuacuaccacaagccccuggacuucgacgccagccucuucauccugcuggacgacaucuucgcgcgcaccgccaaggaggugcgggaccagaagaugaaggacgacaagacgcgccagcuccuguccaagagccuguccgaggagcuccagaagggguacgagcugcagcuggagcggcucaaggagcugaaccgccugggcaagaaggucaacauccacgaccagcucggcaucaagaacggggugcugaacaacgccuucaaccaccugaucuacaaggacggcgagagcuucaagaccaagcucaccuacuccagcgcccugaccuccuucgagagcgcggagaacgggaucgagaucucccagagcggccugcuguuccugcuguccauguuccucaagcggaaggagaucgaggaccugaagaaccgcaacaagggguucaaggccaagguggucaucgacgaggacggcaaggugaacggccugaaguucauggccacgcacuggguguucagcuaccucugcuucaaggggcugaaguccaagcugagcaccgaguuccacgaggagacccuccugauccagaucaucgacgagcugagcaagguccccgacgagcucuacugcgccuucgacaaggagacccgggacaaguucaucgaggacaucaacgaguacgugaaggagggccaccaggacuucucccuggaggacgccaaggugauccacccggucauccgcaagcgguacgagaacaaguucaacuacuucgcgauccgcuuccuggacgaguucgugaaguuccccagccuccgguuccaggugcacgucgggaacuacgugcacgaccgccggaucaagaacaucgacggcacgaccuucgagaccgagcgcguggucaaggaccggaucaagguguucggccgccuguccgagaucagcuccuacaaggcccaguaccugagcuccgucagcgacaagcacgacgagaccgggugggagaucuuccccaaccccuccuacguguucaucaacaacaacaucccgauccacaucagcguggacacguccuucaagaaggagaucgccgacuucaagaagcuccggcgcgcccagguccccgacgagcugaagauccgcggcgccgagaagaagcggaaguucgagaucacccagaugaucgggagcaaguccgugcugaaccaggaggagcccaucgcgcuccugagccugaacgagauccccgcccugcucuacgagauccugaucaacggcaaggagccggccgagaucgagcgcaucaucaaggacaagcugaacgagcggcaggacgugaucaagaacuacaaccccgagaacuggcuccccgccucccagaucagccgccggcugcgcuccaacaagggggagcggaucaucaacaccgacaagcugcuccagcuggucaccaaggagcugcucgugacggagcagaagcugaagaucaucagcgacaaccgcgaggcccugaagcagaagaaggagggcaaguacauccggaaguucaucuucaccaacuccgagcucggccgcgaggcgaucuggcuggccgacgacaucaagcgguucaugcccgccgacgugcgcaaggaguggaagggguaccagcacagccagcugcagcagagccucgccuucuacaacucccggccgaaggaggcccuggcgauccuggagagcuccuggaaccucaaggacgagaagaucaucuggaacgaguggauccucaagagcuucacccagaacaaguucuucgacgccuucuacaacgaguaccugaagggccgcaagaaguacuucgccuuccucuccgagcacaucguccaguacaccagcaacgccaagaaccugcagaaguucaucaagcagcagaugcccaaggaccuguucgagaagcggcacuacaucaucgaggaccuccagacggagaagaacaagauccuguccaagcccuucaucuucccccgcgggaucuucgacaagaagccgaccuucaucaagggcgugaagguggaggacagccccgaguccuucgcgaacugguaccaguacggguaccagaaggaccaccaguuccagaaguucuacgacuggaagcgggacuacagcgacgucuuccuggagcaccucggcaagcccuucaucaacaacggcgaccgccggacccuggggauggaggagcugaaggagcgcaucaucaucaagcaggaccucaagaucaagaagaucaagauccaggaccuguuccugcgccucaucgccgagaaccuguuccagaagguguucaaguacuccgccaagcugccccucagcgacuucuaccugacccaggaggagcggauggagaaggagaacauggccgcccugcagaacgugcgcgaggagggcgacaaguccccgaacaucaucaaggacaacuucaucuggagcaagaugauccccuacaagaaggggcagaucaucgagaacgcggucaagcucaaggacaucggcaagcugaacgugcugucccucgacgacaaggugcagacgcugcugagcuacgacgacgccaagcccugguccaagaucgcccucgagaacgaguucagcaucggggagaacagcuacgaggucauccggcgcgagaagcuguucaaggagauccagcaguucgaguccgagauccuguuccggagcggcugggacggcaucaaccaccccgcccagcucgaggacaaccgcaacccgaaguucaagauguacaucgugaacgggauccugcggaaguccgccggccuguacagccagggggaggacaucugguucgaguacaacgcggacuucaacaaccucgacgccgacgugcuggagaccaaguccgagcugguccagcucgccuuccuggugaccgccauccgcaacaaguucgcccacaaccagcugcccgcgaaggaguucuacuucuacauccgggccaaguacggcuucgccgacgagcccagcguggcccucgucuaccugaacuucaccaaguacgcgaucaacgaguucaagaaggugaugaucuga

SEQ ID NO: 11177 - RNA, 3453 nt, Artificial Sequence
  Cas13b variant__Flavobacterium branchiophilum__WP_014084666.1__Cas13b
auggagaaccugaacaagauccucgacaaggagaacgagaucugcaucagcaagaucuucaacaccaagggcaucgccgcccccaucaccgagaaggcgcuggacaacaucaaguccaagcagaagaacgaccugaacaaggaggcccgccuccacuacuucagcaucgggcacuccuucaagcagaucgacacgaagaagguguucgacuacguccugaucgaggagcugaaggacgagaagccgcucaaguucaucacccugcagaaggacuucuucaccaaggaguucagcaucaagcugcagaagcucaucaacuccauccggaacaucaacaaccacuacgugcacaacuucaacgacaucaaccugaacaagaucgacagcaacguguuccacuuccugaaggaguccuucgagcucgccaucaucgagaaguacuacaaggucaacaagaaguacccccuggacaacgagaucgugcuguuccucaaggagcuguucaucaaggacgagaacaccgcccugcucaacuacuucacgaaccugagcaaggacgaggccaucgaguacauccugaccuucaccaucaccgagaacaagaucuggaacaucaacaacgagcacaacauccucaacaucgagaagggcaaguaccugacguucgaggcgaugcuguuccucaucaccaucuuccuguacaagaacgaggccaaccaccuccuccccaagcuguacgacuucaagaacaacaaguccaagcaggagcuguucaccuucuucagcaagaaguucaccucccaggacaucgacgccgaggaggggcaccucaucaaguuccgcgacaugauccaguaccugaaccacuaccccacggccuggaacaacgaccugaagcucgagagcgagaacaagaacaagaucaugaccaccaagcugaucgacuccaucaucgaguucgagcugaacagcaacuacccguccuucgcgaccgacauccaguucaagaaggaggccaaggccuuccucuucgccagcaacaagaagcggaaccagacguccuucagcaacaaguccuacaacgaggagauccgccacaacccccacaucaagcaguaccgggacgagaucgccagcgcgcugacccccaucagcuucaacgugaaggaggacaaguucaagaucuucgucaagaagcacgugcuggaggaguacuuccccaacuccaucggcuacgagaaguuccucgaguacaacgacuucaccgagaaggagaaggaggacuucgggcugaagcuguacagcaacccgaagaccaacaagcucaucgagcgcaucgacaaccacaagcuggugaagucccacggccggaaccaggaccgcuucauggacuucagcaugcgguuccuggccgagaacaacuacuucggcaaggacgccuucuucaagugcuacaaguucuacgacacgcaggagcaggacgaguuccuccaguccaacgagaacaacgacgacgucaaguuccacaaggggaaggugaccaccuacaucaaguacgaggagcaccugaagaacuacagcuacugggacugccccuucguggaggagaacaacuccaugagcgucaagaucuccaucggcagcgaggagaagauccugaagauccagcgcaaccucaugaucuacuuccuggagaacgcccuguacaacgagaacguggagaaccagggguacaagcuggugaacaacuacuaccgggagcucaagaaggacgucgaggaguccaucgccagccuggaccugaucaaguccaaccccgacuucaagagcaaguacaagaagauccuccccaagcgccugcugcacaacuacgcgccggccaagcaggacaaggcccccgagaacgccuucgagacccuccugaagaaggccgacuuccgggaggagcaguacaagaagcugcucaagaaggcggagcacgagaagaacaaggaggacuucgugaagcgcaacaagggcaagcaguucaagcugcacuucauccggaaggccugccagaugauguacuucaaggagaaguacaacacgcugaaggaggggaacgccgccuucgagaagaaggaccccgugaucgagaagcgcaagaacaaggagcacgaguucggccaccacaagaaccucaacaucacccgggaggaguucaacgacuacugcaaguggauguucgccuucaacggcaacgacuccuacaagaaguaccugcgcgaccuguucagcgagaagcacuucuucgacaaccaggaguacaagaaccucuucgaguccagcgucaaccuggaggcguucuacgccaagaccaaggagcuguucaagaaguggaucgagaccaacaagcccacgaacaacgagaaccgguacacccucgagaacuacaagaaccugauccugcagaagcaggucuucaucaacguguaccacuucuccaaguaccucaucgacaagaaccugcugaacagcgagaacaacgugauccaguacaagagccucgagaacguggaguaccugaucuccgacuucuacuuccagagcaagcuguccaucgaccaguacaagaccugcgggaagcuguucaacaagcucaagagcaacaagcuggaggacugccugcuguacgagaucgccuacaacuacaucgacaagaagaacgugcacaagaucgacauccagaagauccugaccuccaagaucauccucacgaucaacgacgccaacaccccguacaagaucagcguccccuucaacaagcuggagcgcuacaccgagaugaucgcgaucaagaaccagaacaaccugaaggcccgguuccucaucgaccugccccuguaccucuccaagaacaagaucaagaagggcaaggacagcgccggguacgagaucaucaucaagaacgaccuggagaucgaggacaucaacaccaucaacaacaagaucaucaacgacuccgugaaguucacggagguccugauggagcucgagaaguacuucauccugaaggacaagugcauccugagcaagaacuacaucgacaacuccgagauccccagccucaagcaguucuccaagguguggaucaaggagaacgagaacgagaucaucaacuaccgcaacaucgccugccacuuccaccucccgcugcuggagaccuucgacaaccugcugcucaacguggagcagaaguucaucaaggaggagcugcagaacgucagcaccaucaacgaccuguccaagccccaggaguaccucauccugcuguucaucaaguucaagcacaacaacuucuaccucaaccuguucaacaagaacgagagcaagaccaucaagaacgacaaggaggugaagaagaaccgcgugcugcagaaguucaucaaccaggucauccucaagaagaaguga

SEQ ID NO: 11178 - RNA, 3642 nt, Artificial Sequence
  Cas13b variant__Flavobacterium columnare__WP_060381855.1__Cas13b
augagcuccaagaacgagagcuacaacaagcagaagaccuucaaccacuacaagcaggaggacaaguacuucuucggcggguuccugaacaacgccgacgacaaccuccgccaggugggcaaggaguucaagacccggaucaacuucaaccacaacaacaacgagcuggccuccgucuucaaggacuacuucaacaaggagaaguccguggcgaagcgcgagcacgcccugaaccuccuguccaacuacuuccccgugcuggagcggauccagaagcacacgaaccacaacuucgagcagacccgcgagaucuucgagcuccugcuggacaccaucaagaagcuccgggacuacuacacccaccacuaccacaagccgaucacgaucaaccccaaggucuacgacuuccuggacgacacccugcucgacgugcugaucaccaucaagaagaagaaggugaagaacgacaccagccgcgagcugcucaaggagaaguuccggcccgagcugacgcagcugaagaaccagaagcgcgaggagcucaucaagaaggggaagaagcugcuggaggagaaccucgagaacgccgucuucaaccacugccugcggcccuuccuggaggagaacaagaccgacgacaagcagaacaagaccgugucccuccgcaaguaccgcaagagcaagccgaacgaggagaccuccaucacgcugacccagagcggccugguguuccucaucuccuucuuccugcaccggaaggaguuccaggucuucaccagcgggcuggagggcuucaaggccaaggugaacaccaucaaggaggaggagaucucccucaacaagaacaacaucguguacaugaucacgcacuggagcuacuccuacuacaacuucaagggccugaagcaccggaucaagaccgaccagggggucagcacccuggagcagaacaacaccacgcacucccucaccaacaccaacaccaaggaggcccugcugacgcagaucguggacuaccucagcaaggugcccaacgagaucuacgagacccuguccgagaagcagcagaaggaguucgaggaggacaucaacgaguacaugcgcgagaaccccgagaacgaggacagcaccuucagcuccaucgucagccacaaggugauccggaagcgcuacgagaacaaguucaacuacuucgcgaugcgguuccuggacgaguacgccgagcuccccacccugcgcuucauggugaacuucggcgacuacaucaaggaccggcagaagaagauccuggaguccauccaguucgacagcgagcgcaucaucaagaaggagauccaccucuucgagaagcuggggcuggucacggaguacaagaagaacguguaccucaaggagaccuccaacaucgaccugagccgguucccgcuguuccccucccccagcuacgugauggccaacaacaacauccccuucuacaucgacucccgcagcaacaaccucgacgaguaccugaaccagaagaagaaggcccagucccagaaccgcaagcggaaccugaccuucgagaaguacaacaaggagcagagcaaggacgcgaucaucgccaugcugcagaaggagaucggcgucaaggaccuccagcagcgcuccaccaucgggcugcugagcugcaacgagcucccguccaugcuguacgaggugaucgugaaggacaucaagggcgccgagcuggagaacaagaucgcccagaagauccgggagcaguaccagagcauccgcgacuucacgcucgacagcccccagaaggacaacauccccaccacccugaccaagacgaucagcaccgacaccuccgucaccuucgagaaccagcccaucgacaucccgcggcugaagaacgcccuccagaaggagcugacccugacgcaggagaagcuccugaacgugaagcagcacgagaucgaggucgacaacuacaaccgcaacaagaacaccuacaaguucaagaaccagcccaaggacaagguggacgacaacaagcugcagcggaaguacguguucuaccgcaacgagaucggccaggaggcgaacuggcucgccagcgaccugauccacuucaugaagaacaagagccuguggaagggguacaugcacaacgagcuccaguccuuccuggccuucuucgaggacaagaagaacgacugcaucgcccugcucgagaccgucuucaaccugaaggaggacugcauccugaccaaggaccucaagaaccuguuccugaagcacggcaacuucaucgacuucuacaaggaguaccucaagcugaaggaggacuuccugaacacggagagcaccuuccucgagaacggguucaucggccugccgcccaagauccugaagaaggagcucuccaagcggcugaacuacaucuucaucguguuccagaagcgccaguucaucaucaaggagcuggaggagaagaagaacaaccucuacgccgacgcgaucaaccugagccggggcaucuucgacgagaagcccaccaugauccccuucaagaagcccaaccccgacgaguucgccuccugguucguggccagcuaccaguacaacaacuaccaguccuucuacgagcugaccccggacaagaucgagaacgacaagaagaagaaguacaagaaccuccgcgccaucaacaaggucaagauccaggacuacuaccugaagcugaugguggacacgcucuaccaggaccuguucaaccagccccuggacaagagccucuccgacuucuacgugagcaagaccgaccgggagaagaucaaggccgacgcgaaggccuaccagaagcgcaacgacuccuuccuguggaacaaggucauccaccugagccuccagaacaaccggaucaccgccaaccccaagcugaaggacaucgggaaguacaagcgcgcccugcaggacgagaagaucgccacccuccugacguacgacgaccggaccuggaccuacgcgcugcagaagcccgagaaggagaacgagaacgacuacaaggagcuccacuacaccgcccugaacauggagcugcaggaguacgagaaggugcgcuccaagaagcuccugaagcagguccaggagcuggagaagcagauccucgacaaguucuacgacuucagcaacaacgccacgcacccggaggaccuggagaucgaggacaagaagggcaagcggcaccccaacuucaagcuguacaucaccaaggcccuccugaagaacgaguccgagaucaucaaccuggagaacaucgacaucgagauccucaucaaguacuacgacuacaacaccgagaagcugaaggagaagaucaagaacauggacgaggacgagaaggcgaagaucgugaacaccaaggagaacuacaacaagaucacgaacgugcugaucaagaaggcccucgugcugaucaucauccgcaacaagauggcccacaaccaguacccgcccaaguucaucuacgaccuggccacccgcuucguccccaagaaggaggaggaguacuucgccugcuacuucaaccggguguucgagaccaucaccacggagcucugggagaacaagaagaaggcgaaggagaucguguga

SEQ ID NO: 11179 - RNA, 3540 nt, Artificial Sequence
  Cas13b variant__Flavobacterium columnare__WP_014165541.1__Cas13b
augagcuccaagaacgagagcuacaacaagcagaagacguucaaccacuacaagcaggaggacaaguacuucuucggcggguuccugaacaacgccgacgacaaccuccgccaggugggcaaggaguucaagacccggaucaacuucaaccacaacaacaacgagcuggccuccgucuucaaggacuacuucaacaaggagaaguccguggcgaagcgcgagcacgcccugaaccuccuguccaacuacuuccccgugcuggagcggauccagaagcacacgaaccacaacuucgagcagacccgcgagaucuucgagcuccugcuggacaccaucaagaagcuccgggacuacuacacccaccacuaccacaagcccaucacgaucaaccccaagaucuacgacuuccuggacgacacccugcucgacguccugaucaccaucaagaagaagaaggugaagaacgacaccagccgcgagcugcucaaggagaagcugcggcccgagcugacgcagcucaagaaccagaagcgcgaggagcugaucaagaaggggaagaagcugcucgaggagaaccuggagaacgccguguucaaccacugccugcggcccuuccucgaggagaacaagaccgacgacaagcagaacaagaccgucucccugcgcaaguaccgcaagagcaagccgaacgaggagaccuccaucacgcugacccagagcggccucguguuccugauguccuucuuccugcaccggaaggaguuccagguguucaccagcgggcucgagggcuucaaggccaaggucaacaccaucaaggaggaggagaucucccugaacaagaacaacaucguguacaugaucacgcacuggagcuacuccuacuacaacuucaagggccugaagcaccggaucaagaccgaccagggggugagcacccucgagcagaacaacaccacgcacucccugaccaacaccaacaccaaggaggcccugcucacgcagaucgucgacuaccugagcaaggugcccaacgagaucuacgagacccuguccgagaagcagcagaaggaguucgaggaggacaucaacgaguacaugcgcgagaaccccgagaacgaggacagcaccuucagcuccaucgugagccacaaggucauccggaagcgcuacgagaacaaguucaacuacuucgcgaugcgguuccucgacgaguacgccgagcugcccacccugcgcuucauggugaacuucggcgacuacaucaaggaccggcagaagaagauccucgaguccauccaguucgacagcgagcgcaucaucaagaaggagauccaccuguucgagaagcugucccucgugacggaguacaagaagaacgucuaccugaaggagaccagcaacaucgaccugucccgguucccccucuuccccaaccccagcuacgugauggccaacaacaacauccccuucuacaucgacucccgcagcaacaaccuggacgaguaccugaaccagaagaagaaggcccagucccagaacaagaagcgcaaccugaccuucgagaaguacaacaaggagcagagcaaggacgcgaucaucgccaugcuccagaaggagaucggggugaaggaccugcagcagcgguccaccaucggccugcucagcugcaacgagcugccguccaugcuguacgaggucaucgugaaggacaucaagggggccgagcucgagaacaagaucgcccagaagauccgcgagcaguaccagagcauccgggacuucacgcuggacagcccccagaaggacaacauccccaccacccugaucaagaccaucaacacggacagcuccgugaccuucgagaaccagcccaucgacaucccgcgccucaagaacgccauccagaaggagcugacccugacccaggagaagcuccugaacgucaaggagcacgagaucgagguggacaacuacaaccggaacaagaacaccuacaaguucaagaaccagcccaagaacaaggucgacgacaagaagcugcagcgcaaguacguguucuaccggaacgagauccgccaggaggcgaacuggcucgccagcgaccugauccacuucaugaagaacaagagccuguggaagggcuacaugcacaacgagcuccaguccuuccuggccuucuucgaggacaagaagaacgacugcaucgcccugcucgagacgguguucaaccugaaggaggacugcauccugaccaagggccucaagaaccuguuccugaagcacgggaacuucaucgacuucuacaaggaguaccucaagcugaaggaggacuuccugaacaccgagagcaccuuccucgagaacggccugaucgggcugccgcccaagauccucaagaaggagcuguccaagcgguucaaguacaucuucaucgucuuccagaagcgccaguucaucaucaaggagcuggaggagaagaagaacaaccucuacgccgacgcgaucaaccugagccggggcaucuucgacgagaagccgacgaugauccccuucaagaagcccaaccccgacgaguucgccuccugguucguggccagcuaccaguacaacaacuaccaguccuucuacgagcugaccccggacaucguggagcgcgacaagaagaagaaguacaagaaccuccgggccaucaacaaggucaagauccaggacuacuaccugaagcugaugguggacacccucuaccaggaccuguucaaccagccccuggacaagagccucuccgacuucuacgugagcaaggccgagcgcgagaagaucaaggcggacgccaaggccuaccagaagcggaacgacuccagccuguggaacaaggucauccaccugucccuccagaacaaccgcaucaccgccaaccccaagcugaaggacaucggcaaguacaagcgggcccugcaggacgagaagaucgcgacgcuccugaccuacgacgaccgcaccuggaccuacgcccugcagaagcccgagaaggagaacgagaacgacuacaaggagcuccacuacacggcccugaacauggagcugcaggaguacgagaaggugcggagcaaggagcuccugaagcagguccaggagcuggagaagcagauccucgaggaguacaccgacuuccuguccacccagauccacccggccgacuucgagcgcgaggggaaccccaacuucaagaaguaccuggcgcacagcauccucgagaacgaggacgaccuggacaagcugcccgagaagguggaggccaugcgcgagcucgacgagaccaucacgaacccgaucaucaagaaggccaucgugcugaucaucauccggaacaagauggcccacaaccaguacccgcccaaguucaucuacgaccuggccaaccgcuucgugcccaagaaggaggaggaguacuucgcgaccuacuucaaccgggucuucgagaccaucaccaaggagcucugggagaacaaggagaagaaggacaagacccagguguga

SEQ ID NO: 11180 - RNA, 3642 nt, Artificial Sequence
  Cas13b variant__Flavobacterium columnare__WP_063744070.1__Cas13b
augagcuccaagaacgagagcuacaacaagcagaagaccuucaaccacuacaagcaggaggacaaguacuucuucggcggguuccugaacaacgccgacgacaaccuccgccaggugggcaaggaguucaagacccggaucaacuucaaccacaacaacaacgagcuggccuccgucuucaaggacuacuucaacaaggagaaguccguggcgaagcgcgagcacgcccugaaccuccuguccaacuacuuccccgugcuggagcggauccagaagcacacgaaccacaacuucgagcagacccgcgagaucuucgagcuccugcuggacaccaucaagaagcuccgggacuacuacacccaccacuaccacaagccgaucacgaucaaccccaagaucuacgacuuccuggacgacacccugcucgacguccugaucaccaucaagaagaagaaggugaagaacgacaccagccgcgagcugcucaaggagaagcugcggcccgagcugacgcagcucaagaaccagaagcgcgaggagcugaucaagaaggggaagaagcugcucgaggagaaccuggagaacgccguguucaaccacugccugcggcccuuccucgaggagaacaagaccgacgacaagcagaacaagaccgucucccugcgcaaguaccgcaagagcaagccgaacgaggagaccuccaucacgcugacccagagcggccucguguuccugauguccuucuuccugcaccggaaggaguuccagguguucaccagcgggcucgagggcuucaaggccaaggucaacaccaucaaggaggagaagaucucccugaacaagaacaacaucguguacaugaucacgcacuggagcuacuccuacuacaacuucaagggccugaagcaccggaucaagaccgaccagggggugagcacccucgagcagaacaacaccacgcacucccugaccaacaccaacaccaaggaggcccugcucacgcagaucgucgacuaccugagcaaggugcccaacgagaucuacgagacccuguccgagaagcagcagaaggaguucgaggaggacaucaacgaguacaugcgcgagaaccccgagaacgaggacagcaccuucagcuccaucgugagccacaaggucauccggaagcgcuacgagaacaaguucaacuacuucgcgaugcgguuccucgacgaguacgccgagcugcccacccugcgcuucauggugaacuucggcgacuacaucaaggaccggcagaagaagauccucgaguccauccaguucgacagcgagcgcaucaucaagaaggagauccaccuguucgagaagcuggggcucgugacggaguacaagaagaacgucuaccugaaggagaccuccaacaucgaccugagccgguucccccucuuccccucccccagcuacgugauggccaacaacaacauccccuucuacaucgacucccgcagcaacaaccuggacgaguaccugaaccagaagaagaaggcccagucccagaaccgcaagcggaaccugaccuucgagaaguacaacaaggagcagagcaaggacgcgaucaucgccaugcuccagaaggagaucggcgugaaggaccugcagcagcgcuccaccaucgggcugcucagcugcaacgagcugccguccaugcuguacgaggucaucgugaaggacaucaagggcgccgagcucgagaacaagaucgcccagaagauccgggagcaguaccagagcauccgcgacuucacgcugaacagcccccagaaggacaacauccccaccacccugaucaagaccaucagcacggacaccuccgugaccuucgagaaccagcccaucgacaucccgcggcucaagaacgccauccagaaggagcuggcgcugacccaggagaagcuccugaacgucaagcagcacgagaucgaggugaacaacuacaaccgcaacaagaacaccuacaaguucaagaaccagcccaaggacaaggucgacgacaacaagcugcagcggaaguacguguucuaccgcaacgagaucggccaggaggccaacuggcucgccagcgaccugauccacuucaugaagaacaagagccuguggaagggguacaugcacaacgagcuccaguccuuccuggccuucuucgaggacaagaagaacgacugcaucgcccugcucgagacgguguucaaccugaaggaggacugcauccugaccaaggaccucaagaaccuguuccugaagcacggcaacuucaucgacuucuacaaggaguaccucaagcugaaggaggacuuccugaacaccgagagcaccuuccucgagaacggguucaucggccugccgcccaagauccugaagaaggagcucuccaagcggcugaacuacaucuucaucgucuuccagaagcgccaguucaucaucaaggagcuggaggagaagaagaacaaccucuacgcggacgccaucaaccugagccggggcaucuucgacgagaagccgacgaugauccccuucaagaagcccaaccccgacgaguucgccuccugguucguggccagcuaccaguacaacaacuaccaguccuucuacgagcugaccccggacaagaucgagaacgacaagaagaagaaguacaagaaccuccgcgccaucaacaaggugaagauccaggacuacuaccugaagcugauggucgacacccucuaccaggaccuguucaaccagccccuggacaagagccucuccgacuucuacgugagcaagaccgaccgggagaagaucaaggcggacgccaaggccuaccagaagcgcaacgacuccuuccuguggaacaaggugauccaccugagccuccagaacaaccggaucacggccaaccccaagcugaaggacaucgggaaguacaagcgcgcccugcaggacgagaagaucgcgacccuccugaccuacgacgaccggaccuggacguacgcccugcagaagcccgagaaggagaacgagaacgacuacaaggagcuccacuacaccgcccugaacauggagcugcaggaguacgagaagguccgcuccaagaagcuccugaagcagguccaggagcuggagaagcagauccucgacaaguucuacgacuucagcaacaacgccacccacccggaggaccuggagaucgaggacaagaagggcaagcggcaccccaacuucaagcuguacaucaccaaggcgcuccugaagaacgaguccgagaucaucaaccuggagaacaucgacaucgagauccucaucaaguacuacgacuacaacacggagaagcugaaggagaagaucaagaacauggacgaggacgagaaggccaagaucgugaacaccaaggagaacuacaacaagaucaccaacgugcugaucaagaaggcccucgugcugaucaucauccgcaacaagauggcccacaaccaguacccgcccaaguucaucuacgaccuggccacccgcuucgugcccaagaaggaggaggaguacuucgcgugcuacuucaaccgggucuucgagacgaucaccaccgagcucugggagaacaagaagaaggccaaggagaucguguga

SEQ ID NO: 11181 - RNA, 3645 nt, Artificial Sequence
  Cas13b variant__Flavobacterium columnare__WP_065213424.1__Cas13b
augagcuccaagaacgagagcuacaacaagcagaagacguucaaccacuacaagcaggaggacaaguacuucuucggcggguuccugaacaacgccgacgacaaccuccgccaggugggcaaggaguucaagacccggaucaacuucaaccacaacaacaacgagcuggccuccgucuucaaggacuacuucaacaaggagaaguccguggcgaagcgcgagcacgcccugaaccuccuguccaacuacuuccccgugcuggagcggauccagaagcacacgaaccacaacuucgagcagacccgcgagaucuucgagcuccugcuggacaccaucaagaagcuccgggacuacuacacccaccacuaccacaagccgaucacgaucaaccccaagaucuacgacuuccuggacgacacccugcucgacguccugaucaccaucaagaagaagaaggugaagaacgacaccagccgcgagcugcucaaggagaagcugcggcccgagcugacgcagcucaagaaccagaagcgcgaggagcugaucaagaaggggaagaagcugcucgaggagaaccuggagaacgccguguucaaccacugccugauccccuuccucgaggagaacaagaccgacgacaagcagaacaagaccgucucccugcggaaguaccgcaagagcaagccgaacgaggagaccuccaucacgcugacccagagcggccucguguuccugauguccuucuuccugcaccggaaggaguuccagguguucaccagcgggcucgagcgcuucaaggccaaggucaacaccaucaaggaggaggagaucucccugaacaagaacaacaucguguacaugaucacgcacuggagcuacuccuacuacaacuucaagggccugaagcaccggaucaagaccgaccagggcgugagcacccucgagcagaacaacaccacgcacucccugaccaacaccaacaccaaggaggcccugcucacgcagaucgucgacuaccugagcaaggugcccaacgagaucuacgagacccuguccgagaagcagcagaaggaguucgaggaggacaucaacgaguacaugcgcgagaaccccgagaacgaggacagcaccuucagcuccaucgugagccacaaggucauccggaagcgcuacgagaacaaguucaacuacuucgcgaugcgguuccucgacgaguacgccgagcugcccacccugcgcuucauggugaacuucggggacuacaucaaggaccggcagaagaagauccucgaguccauccaguucgacagcgagcgcaucaucaagaaggagauccaccuguucgagaagcugucccucgugacggaguacaagaagaacgucuaccugaaggagaccagcaacaucgaccugucccgguucccccucuuccccaaccccagcuacgugauggccaacaacaacauccccuucuacaucgacucccgcagcaacaaccuggacgaguaccugaaccagaagaagaaggcccagucccagaacaagaagcgcaaccugaccuucgagaaguacaacaaggagcagagcaaggacgcgaucaucgccaugcuccagaaggagaucggcgugaaggaccugcagcagcgguccaccaucgggcugcucagcugcaacgagcugccguccaugcuguacgaggucaucgugaaggacaucaagggcgccgagcucgagaacaagaucgcccagaagauccgcgagcaguaccagagcauccgggacuucacgcuggacagcccccagaaggacaacauccccaccacccugaucaagaccaucaacacggacagcuccgugaccuucgagaaccagcccaucgacaucccgcgccucaagaacgcccugcagaaggagcugacccucacccaggagaagcugcugaacgucaaggagcacgagaucgagguggacaacuacaaccggaacaagaacaccuacaaguucaagaaccagcccaagaacaaggucgacgacaagaagcuccagcgcaaguacguguucuaccggaacgagauccgccaggaggcgaacuggcuggccagcgaccugauccacuucaugaagaacaagagccucuggaagggguacaugcacaacgagcugcaguccuuccuggccuucuucgaggacaagaagaacgacugcaucgcccuccuggagacgguguucaaccugaaggaggacugcauccucaccaagggccugaagaaccuguuccucaagcacggcaacuucaucgacuucuacaaggaguaccugaagcugaaggaggacuuccucagcaccgaguccaccuuccuggagaacggguucaucggccugccgcccaagauccucaagaaggagcugagcaagcggcugaaguacaucuucaucgucuuccagaagcgccaguucaucaucaaggagcucgaggagaagaagaacaaccuguacgccgacgcgaucaaccugucccgggggaucuucgacgagaagccgacgaugauccccuucaagaagcccaaccccgacgaguucgccagcugguucguggccuccuaccaguacaacaacuaccagagcuucuacgagcucaccccggacaucguggagcgcgacaagaagaagaaguacaagaaccugcgggccaucaacaaggucaagauccaggacuacuaccugaagcucaugguggacacccuguaccaggaccuguucaaccagccccucgacaagucccugagcgacuucuacguguccaaggccgagcgcgagaagaucaaggcggacgccaaggccuaccagaagcugaacgacagcucccucuggaacaaggucauccaccugagccugcagaacaaccggaucaccgccaaccccaagcucaaggacaucggcaaguacaagcgcgcccugcaggacgagaagaucgcgacgcugcucaccuacgacgcccggaccuggaccuacgcccugcagaagcccgagaaggagaacgagaacgacuacaaggagcugcacuacacggcccucaacauggagcugcaggaguacgagaaggugcgcuccaaggagcugcucaagcagguccaggagcuggagaagaagauccuggacaaguucuacgacuucagcaacaacgcgucccacccggaggaccucgagaucgaggacaagaagggcaagcggcaccccaacuucaagcuguacaucaccaaggcccugcucaagaacgagagcgagaucaucaaccuggagaacaucgacaucgagauccugcucaaguacuacgacuacaacaccgaggagcugaaggagaagaucaagaacauggacgaggacgagaaggccaagaucaucaacaccaaggagaacuacaacaagaucacgaacgugcugaucaagaaggcccucgugcugaucaucauccgcaacaagauggcccacaaccaguacccgcccaaguucaucuacgaccuggcgaaccgcuucgugcccaagaaggaggaggaguacuucgccaccuacuucaaccgggucuucgagaccaucaccaaggagcucugggagaacaaggagaagaaggacaagacccagguguga

SEQ ID NO: 11182 - RNA, 3468 nt, Artificial Sequence
  Cas13b variant__Flavobacterium sp.__WP_045968377.1__Cas13b
auggacaacaacaucaccguggagaagaccgagcugggccucgggaucacguacaaccacgacaaggucgaggacaagcacuacuucggcggguucuucaaccuggcccagaacaacaucgaccugguggcccaggaguucaagaagcgccuccugauccagggcaaggacagcaucaacaucuucgcgaacuacuucuccgaccagugcagcaucaccaaccuggagcgggggaucaagauccucgccgaguacuuccccguggucuccuacaucgaccuggacgagaagaacaagagcaaguccauccgcgagcaccugauccuccugcuggagaccaucaacaaccuccggaacuacuacacccacuacuaccacaagaagaucaucaucgacggcagccuguucccgcugcucgacacgauccugcugaagguggugcucgagaucaagaagaagaagcugaaggaggacaagaccaagcagcugcucaagaagggccuggagaaggagaugaccauccuguucaaccucaugaaggccgagcagaaggagaagaagaucaagggguggaacaucgacgagaacaucaagggcgccguccugaaccgcgccuucucccaccuccucuacaacgacgagcugagcgacuaccggaaguccaaguacaacaccgaggacgagacgcugaaggacacccucaccgagagcgggauccuguuccugcucuccuucuuccugaacaagaaggagcaggagcagcugaaggcgaacaucaagggcuacaaggggaagaucgccagcauccccgacgaggagaucacccucaagaacaacucccugcgcaacauggccacgcacuggaccuacagccaccugaccuacaagggccucaagcaccggaucaagaccgaccacgagaaggagacgcugcuggugaacaugguggacuaccucuccaaggucccccacgagaucuaccagaaccugagcgagcagaacaagucccuguuccucgaggacaucaacgaguacaugcgcgacaacgaggagaaccacgacagcuccgaggccagccgggugauccaccccgugauccgcaagcgguacgagaacaaguucgcguacuucgccauccgcuuccuggacgaguucgccgaguucccgacccugcgguucauggucaacgugggcaacuacauccacgacaaccgcaagaaggacaucgggggcaccagccucaucaccaaccggacgaucaagcagcagaucaacguguucgggaaccugaccgagauccacaagaagaagaacgacuacuucgagaaggaggagaacaaggagaagacccuggagugggagcuguuccccaaccccuccuaccacuuccagaaggagaacauccccaucuucaucgaccucgagaaguccaaggagaccaacgaccuggccaaggaguacgccaaggagaagaagaagaucuucggcagcagccgcaagaagcagcagaacacggcgaagaagaaccgggagaccaucaucaaccuggucuucgacaaguacaagaccuccgaccgcaagaccgugacguucgagcagccgaccgcccuccugagcuucaacgagcugaacuccuuccucuacgccuuccugguggagaacaagaccggcaaggagcuggagaagaucaucaucgagaagaucgccaaccaguaccagauccucaagaacugcagcuccaccgucgacaagacgaacgacaacauccccaagagcaucaagaagaucgugaacaccaccaccgacuccuucuacuucgaggggaagaagaucgacaucgagaagcuggagaaggacaucacgaucgagaucgagaagaccaacgagaagcuggagaccaucaaggagaacgaggagagcgcccagaacuacaagcggaacgagcgcaacacccagaagcggaagcucuaccgcaaguacguguucuucaccaacgagaucggcaucgaggcgacguggaucaccaacgacauccugcgcuuccuggacaacaaggagaacuggaagggguaccagcacuccgagcuccagaaguucaucagccaguacgacaacuacaagaaggaggcccugggccugcucgaguccgaguggaaccuggagagcgacgccuucuucgggcagaaccugaagcggauguuccaguccaacagcaccuucgagaccuucuacaagaaguaccucgacaaccgcaagaacacgcuggagaccuaccuguccgccaucgagaaccucaagaccaugaccgacguccggcccaaggugcugaagaagaaguggacggagcuguuccgcuucuucgacaagaagaucuaccuccugagcaccaucgagaccaagaucaacgagcugaucaccaagcccaucaaccucagccggggcaucuucgaggagaagccgacguucaucaacggcaagaaccccaacaaggagaacaaccagcaccuguucgccaacugguucaucuacgcgaagaagcagaccauccugcaggacuucuacaaccucccccuggagcagcccaaggccaucaccaaccugaagaagcacaaguacaagcucgagcgcuccaucaacaaccugaagaucgaggacaucuacaucaagcagaugguggacuuccuguaccagaagcuguucgagcagagcuucaucgggucccugcaggaccuguacaccagcaaggagaagcgggagaucgagaagggcaaggccaagaacgagcagacgccggacgaguccuucaucuggaagaagcaggucgagaucaacacccacaacgggcgcaucaucgccaagaccaagaucaaggacaucggcaaguucaagaaccuccugaccgacaacaagaucgcccaccugaucagcuacgacgaccggaucugggacuucucccucaacaacgacggggacaucacgaagaagcuguacagcaucaacaccgagcuggaguccuacgagaccauccgccgggagaagcuccugaagcagauccagcaguucgagcaguuccugcucgagcaggagaccgaguacagcgcggagcgcaagcaccccgagaaguucgagaaggacugcaaccccaacuucaagaaguacaucaucgagggcgugcugaacaagaucauccccaaccacgagaucgaggagaucgagauccugaaguccaaggaggacgucuucaagaucaacuucagcgacauccucauccugaacaacgacaacaucaagaagggcuaccugcucaucaugauccggaacaaguucgcccacaaccagcugaucgacaagaaccuguucaacuucucccuccagcuguacagcaagaacgagaacgagaacuucuccgaguaccugaacaaggugugccagaacaucauccaggaguucaaggagaagcucaaguga

SEQ ID NO: 11183 - RNA, 3480 nt, Artificial Sequence
  Cas13b variant__Myroides odoratimimus__EHO06562.1__Cas13b
augaaggacauccugaccaccgacacgaccgagaagcagaaccgcuucuacagccacaagaucgccgacaaguacuucuucggcggguacuucaaccucgccuccaacaacaucuacgagguguucgaggaggucaacaagcggaacaccuucggcaagcuggcgaagcgcgacaacgggaaccugaagaacuacaucauccacguguucaaggacgagcucagcaucuccgacuucgagaagcggguggccaucuucgccagcuacuuccccauccuggagaccgucgacaagaaguccaucaaggagcgcaaccggacgaucgaccugacccucagccagcgcauccggcaguuccgcgagaugcugaucucccuggugaccgccguggaccagcuccggaacuucuacacccacuaccaccacagcgacaucgucaucgagaacaaggugcuggacuuccugaacuccagcuucguguccacggcccuccacgucaaggacaaguaccugaagaccgacaagaccaaggaguuccugaaggagaccaucgcggccgagcucgacauccugaucgaggccuacaagaagaagcagaucgagaagaagaacacgcgcuucaaggccaacaagcgggaggacauccugaacgcgaucuacaacgaggccuucuggagcuucaucaacgacaaggacaaggacaaggacaaggagaccgugguggccaagggcgccgacgccuacuucgagaagaaccaccacaaguccaacgacccggacuucgcgcucaacaucagcgagaaggggaucgucuaccugcuguccuucuuccucaccaacaaggagauggacagccugaaggccaaccugaccggcuucaagggcaagguggaccgcgaguccgggaacagcaucaaguacauggccacgcagcggaucuacuccuuccacaccuaccgcggccucaagcagaagauccggaccagcgaggagggggugaaggagacccugcugaugcagaugaucgacgagcucagcaagguccccaacgugguguaccagcaccuguccacgacccagcagaacagcuucaucgaggacuggaacgaguacuacaaggacuacgaggacgacgucgagaccgacgaccugucccgcgugauccaccccgugauccggaagcgcuacgaggaccgguucaacuacuucgccauccgcuuccucgacgaguucuucgacuuccccacccugcgguuccagguccaccugggcgacuacgugcacgaccgccgcacgaagcagcucgggaagguggagagcgaccggaucaucaaggagaaggucaccguguucgcccgccugaaggacaucaacuccgcgaaggccagcuacuuccacucccuggaggagcaggacaaggaggagcucgacaacaaguggacccuguucccgaaccccagcuacgacuuccccaaggagcacacccugcagcaccagggcgagcagaagaacgccggcaagaucgggaucuacgucaagcuccgggacacgcaguacaaggagaaggccgcccuggaggaggcgcgcaagucccugaaccccaaggagcggagcgccaccaaggccuccaaguacgacaucaucacccagaucaucgaggccaacgacaacgucaagagcgagaagccgcucguguucaccggccagcccaucgccuaccuguccaugaacgacauccacagcaugcuguucucccuccugacggacaacgcggagcugaagaagacccccgaggagguggaggccaagcucaucgaccagaucgggaagcagaucaacgagauccugagcaaggacaccgacaccaagauccugaagaaguacaaggacaacgaccugaaggagacggacaccgacaagaucacccgcgaccucgcccgggacaaggaggagaucgagaagcugauccuggagcagaagcagcgcgccgacgacuacaacuacaccuccagcaccaaguucaacaucgacaagucccggaagcgcaagcaccuccuguucaacgcggagaagggcaagaucggcguguggcuggccaacgacaucaagcgguucauguucaaggagagcaagagcaaguggaagggguaccagcacacggagcuccagaagcuguucgccuacuucgacaccuccaagagcgaccuggagcucauccuguccaacauggugauggucaaggacuaccccaucgagcugaucgaccucgugaagaagucccgcacccugguggacuuccugaacaaguaccucgaggcccggcuggaguacaucgagaacgucaucacccgcgugaagaacagcaucggcacgccgcaguucaagaccgugcggaaggagugcuucaccuuccugaagaaguccaacuacaccgucgugagccucgacaagcaggucgagcgcauccugagcaugccccuguucaucgagcggggguucauggacgacaagcccacgaugcucgagggcaaguccuacaagcagcacaaggagaaguucgccgacugguucgugcacuacaaggagaacagcaacuaccagaacuucuacgacaccgagguguacgagaucaccaccgaggacaagcgcgagaaggcgaaggugacgaagaagaucaagcagcagcagaagaacgacgucuucacccugaugauggugaacuacaugcuggaggaggugcucaagcuguccagcaacgaccggcugucccucaacgagcuguaccagaccaaggaggagcgcaucgucaacaagcaggucgccaaggacacccaggagcgcaacaagaacuacaucuggaacaaggugguggaccugcagcucugcgacgggcuggugcacaucgacaacgugaagcugaaggacaucggcaacuuccggaaguacgagaacgacagccgcgucaaggaguuccucacguaccaguccgacaucguguggagcgccuaccuguccaacgagguggacagcaacaagcuguacgucaucgagcggcagcucgacaacuacgagagcauccgcuccaaggagcugcugaaggaggugcaggagaucgagugcagcguguacaaccaggucgccaacaaggagucccucaagcagagcggcaacgagaacuucaagcaguacgugcugcaggggcugcuccccaucggcauggacgugcgggagaugcugauccuguccaccgacgucaaguucaagaaggaggagaucauccagcucgggcaggccggcgagguggagcaggaccuguacagccugaucuacauccgcaacaaguucgcgcacaaccagcucccgaucaaggaguucuucgacuucugcgagaacaacuaccgguccaucagcgacaacgaguacuacgccgaguacuacauggagaucuuccgcuccaucaaggagaaguacgccaacuga

SEQ ID NO: 11184 - RNA, 3474 nt, Artificial Sequence
  Cas13b variant__Myroides odoratimimus__WP_006261414.1__Cas13b
augaaggacauccugaccaccgacacgaccgagaagcagaaccgcuucuacagccacaagaucgccgacaaguacuucuucggcggguacuucaaccucgccuccaacaacaucuacgagguguucgaggaggucaacaagcggaacaccuucggcaagcuggcgaagcgcgacaacgggaaccugaagaacuacaucauccacguguucaaggacgagcucagcaucuccgacuucgagaagcggguggccaucuucgccagcuacuuccccauccuggagaccgucgacaagaaguccaucaaggagcgcaaccggacgaucgaccugacccucagccagcgcauccggcaguuccgcgagaugcugaucucccuggugaccgccguggaccagcuccggaacuucuacacccacuaccaccacagcgagaucgucaucgagaacaaggugcuggacuuccugaacuccagccucguguccacggcccugcacgucaaggacaaguaccugaagaccgacaagaccaaggaguuccucaaggagaccaucgcggccgagcuggacauccugaucgaggccuacaagaagaagcagaucgagaagaagaacacgcgcuucaaggccaacaagcgggaggacauccucaacgcgaucuacaacgaggccuucuggagcuucaucaacgacaaggacaaggacaaggagaccgugguggccaagggcgccgacgccuacuucgagaagaaccaccacaaguccaacgacccggacuucgcgcugaacaucagcgagaaggggaucgucuaccugcucuccuucuuccugaccaacaaggagauggacagccugaaggccaaccucaccggcuucaagggcaagguggaccgcgaguccgggaacagcaucaaguacauggccacgcagcggaucuacuccuuccacaccuaccgcggccugaagcagaagauccggaccagcgaggagggggugaaggagacccugcucaugcagaugaucgacgagcugagcaagguccccaacgugguguaccagcaccuguccacgacccagcagaacagcuucaucgaggacuggaacgaguacuacaaggacuacgaggacgacgucgagaccgacgaccucucccgcgugauccaccccgugauccggaagcgcuacgaggaccgguucaacuacuucgccauccgcuuccuggacgaguucuucgacuuccccacccugcgguuccagguccaccucggcgacuacgugcacgaccgccgcacgaagcagcuggggaagguggagagcgaccggaucaucaaggagaaggucaccguguucgcccgccugaaggacaucaacuccgcgaaggccaacuacuuccacagccucgaggagcaggacaaggaggagcuggacaacaaguggacccuguucccgaaccccuccuacgacuuccccaaggagcacacccuccagcaccagggcgagcagaagaacgccggcaagaucgggaucuacgucaagcugcgggacacgcaguacaaggagaaggccgcccuggaggaggcgcgcaagagccucaaccccaaggagcgguccgccaccaaggccagcaaguacgacaucaucacccagaucaucgaggccaacgacaacgugaaguccgagaagccgcugguguucaccggccagcccaucgccuaccugagcaugaacgacauccacuccaugcuguucagccugcugacggacaacgcggagcucaagaagacccccgaggaggucgaggccaagcugaucgaccagaucgggaagcagaucaacgagauccuguccaaggacaccgacaccaagauccugaagaaguacaaggacaacgaccucaaggagacggacaccgacaagaucacccgcgaccuggcccgggacaaggaggagaucgagaagcugauccucgagcagaagcagcgcgccgacgacuacaacuacaccagcuccaccaaguucaacaucgacaagagccggaagcgcaagcaccuccuguucaacgcggagaagggcaagaucggcguguggcucgccaacgacaucaagcgguucaugacggaggaguucaaguccaaguggaagggguaccagcacaccgagcugcagaagcuguucgccuacuacgacaccagcaagagcgaccucgaccugauccuguccgacauggugauggucaaggacuaccccaucgagcucaucgcccuggugaagaagucccgcacccugguggacuuccucaacaaguaccuggaggcccggcugggcuacauggagaacgucaucacgcgcgugaagaacagcaucgggaccccgcaguucaagaccgugcggaaggagugcuucaccuuccucaagaaguccaacuacacggucgugagccuggacaagcaggucgagcgcauccugagcaugccccucuucaucgagcggggcuucauggacgacaagcccaccaugcuggaggggaaguccuaccagcagcacaaggagaaguucgcggacugguucgugcacuacaaggagaacagcaacuaccagaacuucuacgacaccgagguguacgagaucaccacggaggacaagcgcgagaaggccaaggugaccaagaagaucaagcagcagcagaagaacgacgucuucacccugaugauggugaacuacaugcucgaggaggugcugaagcuguccagcaacgaccggcucucccugaacgagcuguaccagaccaaggaggagcgcaucgucaacaagcaggucgccaaggacacgcaggagcgcaacaagaacuacaucuggaacaaggugguggaccuccagcugugcgagggccuggugcggaucgacaaggugaagcucaaggacaucggcaacuuccgcaaguacgagaacgacagccgggucaaggaguuccugaccuaccaguccgacaucguguggagcgccuaccuguccaacgagguggacagcaacaagcucuacgucaucgagcgccagcuggacaacuacgaguccauccggagcaaggagcugcucaaggaggugcaggagaucgagugcagcguguacaaccaggucgccaacaaggagucccugaagcagagcgggaacgagaacuucaagcaguacgugcugcagggccucgugcccaucgggauggacguccgcgagaugcugauccuguccaccgacgugaaguucaucaaggaggagaucauccagcucggccaggcgggggagguggagcaggaccuguacagccugaucuacauccggaacaaguucgcccacaaccagcucccgaucaaggaguucuucgacuucugcgagaacaacuaccgcuccaucagcgacaacgaguacuacgccgaguacuacauggagaucuuccgguccaucaaggagaaguacaccagcuga

SEQ ID NO: 11185 - RNA, 3474 nt, Artificial Sequence
  Cas13b variant__Myroides odoratimimus__EKB06014.1__Cas13b
augaaggacauccugaccaccgacacgaccgagaagcagaaccgcuucuacagccacaagaucgccgacaaguacuucuucggcggguacuucaaccucgccuccaacaacaucuacgagguguucgaggaggucaacaagcggaacaccuucggcaagcuggcgaagcgcgacaacgggaaccugaagaacuacaucauccacguguucaaggacgagcucagcaucuccgacuucgagaagcggguggccaucuucgccagcuacuuccccauccuggagaccgucgacaagaaguccaucaaggagcgcaaccggacgaucgaccugacccucagccagcgcauccggcaguuccgcgagaugcugaucucccuggugaccgccguggaccagcuccggaacuucuacacccacuaccaccacagcgagaucgucaucgagaacaaggugcuggacuuccugaacuccagccucguguccacggcccugcacgucaaggacaaguaccugaagaccgacaagaccaaggaguuccucaaggagaccaucgcggccgagcuggacauccugaucgaggccuacaagaagaagcagaucgagaagaagaacacgcgcuucaaggccaacaagcgggaggacauccucaacgcgaucuacaacgaggccuucuggagcuucaucaacgacaaggacaaggacaaggagaccgugguggccaagggcgccgacgccuacuucgagaagaaccaccacaaguccaacgacccggacuucgcgcugaacaucagcgagaaggggaucgucuaccugcucuccuucuuccugaccaacaaggagauggacagccugaaggccaaccucaccggcuucaagggcaagguggaccgcgaguccgggaacagcaucaaguacauggccacgcagcggaucuacuccuuccacaccuaccgcggccugaagcagaagauccggaccagcgaggagggggugaaggagacccugcucaugcagaugaucgacgagcugagcaagguccccaacgugguguaccagcaccuguccacgacccagcagaacagcuucaucgaggacuggaacgaguacuacaaggacuacgaggacgacgucgagaccgacgaccucucccgcgugauccaccccgugauccggaagcgcuacgaggaccgguucaacuacuucgccauccgcuuccuggacgaguucuucgacuuccccacccugcgguuccagguccaccucggcgacuacgugcacgaccgccgcacgaagcagcuggggaagguggagagcgaccggaucaucaaggagaaggucaccguguucgcccgccugaaggacaucaacuccgcgaaggccagcuacuuccacucccucgaggagcaggacaaggaggagcuggacaacaaguggacccuguucccgaaccccagcuacgacuuccccaaggagcacacccuccagcaccagggcgagcagaagaacgccggcaagaucgggaucuacgucaagcugcgggacacgcaguacaaggagaaggccgcccuggaggaggcgcgcaagucccucaaccccaaggagcggagcgccaccaaggccuccaaguacgacaucaucacccagaucaucgaggccaacgacaacgucaagagcgagaagccgcugguguucaccggccagcccaucgccuaccuguccaugaacgacauccacagcaugcuguucucccugcugacggacaacgcggagcucaagaagacccccgaggagguggaggccaagcugaucgaccagaucgggaagcagaucaacgagauccugagcaaggacaccgacaccaagauccugaagaaguacaaggacaacgaccucaaggagacggacaccgacaagaucacccgcgaccuggcccgggacaaggaggagaucgagaagcugauccucgagcagaagcagcgcgccgacgacuacaacuacaccuccagcaccaaguucaacaucgacaagucccggaagcgcaagcaccuccuguucaacgcggagaagggcaagaucggcguguggcucgccaacgacaucaagcgguucauguucaaggagagcaagagcaaguggaagggguaccagcacacggagcugcagaagcuguucgccuacuucgacaccuccaagagcgaccucgagcugauccuguccgacauggugauggucaaggacuaccccaucgagcucaucgaccuggugcgcaagagccggacccugguggacuuccucaacaaguaccuggaggcccgccugggcuacaucgagaacgucaucacccgggugaagaacuccaucgggacgccgcaguucaagaccgugcgcaaggagugcuucgccuuccucaaggagagcaacuacaccgucgcgucccuggacaagcagaucgagcggauccugagcaugccccucuucaucgagcgcggcuucauggacuccaagcccaccaugcuggagggcaagagcuaccagcagcacaaggaggacuucgccgacugguucgugcacuacaaggagaacuccaacuaccagaacuucuacgacacggagguguacgagaucaucaccgaggacaagcgggagcaggccaaggucaccaagaagaucaagcagcagcagaagaacgacguguucacccugaugauggugaacuacaugcucgaggagguccugaagcugcccagcaacgaccgccucucccugaacgagcuguaccagacgaaggaggagcgcaucgugaacaagcaggucgccaaggacacccaggagcggaacaagaacuacaucuggaacaaggugguggaccuccagcugugcgaggggcuggugcgcaucgacaaggucaagcucaaggacaucggcaacuuccggaaguacgagaacgacagccgcgugaaggaguuccugaccuaccaguccgacaucguguggagcggguaccuguccaacgaggucgacagcaacaagcucuacgugaucgagcggcagcuggacaacuacgagagcauccgcuccaaggagcugcucaaggaggugcaggagaucgagugcaucgucuacaaccagguggccaacaaggagagccugaagcaguccggcaacgagaacuucaagcaguacgugcugcaggggcuccugccgcggggcaccgacguccgcgagaugcugauccucagcacggacgugaaguucaagaaggaggagaucaugcagcuggggcagguccgggagguggagcaggaccuguacucccucaucuacauccgcaacaaguucgcgcacaaccagcugcccaucaaggaguucuucgacuucugcgagaacaacuaccggcccaucagcgacaacgaguacuacgccgaguacuacauggagaucuuccgcuccaucaaggagaaguacgccagcuga

SEQ ID NO: 11186 - RNA, 3480 nt, Artificial Sequence
  Cas13b variant__Myroides odoratimimus__WP_058700060.1__Cas13b
augaaggacauccugaccaccgacacgaccgagaagcagaaccgcuucuacagccacaagaucgccgacaaguacuucuucggcggguacuucaaccucgccuccaacaacaucuacgagguguucgaggaggucaacaagcggaacaccuucggcaagcuggcgaagcgcgacaacgggaaccugaagaacuacaucauccacguguucaaggacgagcucagcaucuccgacuucgagaagcggguggccaucuucgccagcuacuuccccauccuggagaccgucgacaagaaguccaucaaggagcgcaaccggacgaucgaccugacccucagccagcgcauccggcaguuccgcgagaugcugaucucccuggugaccgccguggaccagcuccggaacuucuacacccacuaccaccacagcgacaucgucaucgagaacaaggugcuggacuuccugaacuccagcuucguguccacggcccuccacgucaaggacaaguaccugaagaccgacaagaccaaggaguuccugaaggagaccaucgcggccgagcucgacauccugaucgaggccuacaagaagaagcagaucgagaagaagaacacgcgcuucaaggccaacaagcgggaggacauccugaacgcgaucuacaacgaggccuucuggagcuucaucaacgacaaggacaaggacaaggacaaggagaccgugguggccaagggcgccgacgccuacuucgagaagaaccaccacaaguccaacgacccggacuucgcgcucaacaucagcgagaaggggaucgucuaccugcuguccuucuuccucaccaacaaggagauggacagccugaaggccaaccugaccggcuucaagggcaagguggaccgcgaguccgggaacagcaucaaguacauggccacgcagcggaucuacuccuuccacaccuaccgcggccucaagcagaagauccggaccagcgaggagggggugaaggagacccugcugaugcagaugaucgacgagcucagcaagguccccaacgugguguaccagcaccuguccacgacccagcagaacagcuucaucgaggacuggaacgaguacuacaaggacuacgaggacgacgucgagaccgacgaccugucccgcgugacccaccccgugauccggaagcgcuacgaggaccgguucaacuacuucgccauccgcuuccucgacgaguucuucgacuuccccacgcugcgguuccagguccaccugggcgacuacgugcacgaccgccgcaccaagcagcucgggaagguggagagcgaccggaucaucaaggagaaggucaccguguucgcccgccugaaggacaucaacuccgcgaaggccagcuacuuccacucccuggaggagcaggacaaggaggagcucgacaacaaguggacccuguucccgaaccccagcuacgacuuccccaaggagcacacgcugcagcaccagggcgagcagaagaacgccggcaagaucgggaucuacgucaagcuccgggacacccaguacaaggagaaggccgcccuggaggaggcgcgcaagucccugaaccccaaggagcggagcgccaccaaggccuccaaguacgacaucaucacccagaucaucgaggccaacgacaacgucaagagcgagaagccgcucguguucacgggccagcccaucgccuaccuguccaugaacgacauccacagcaugcuguucucccuccugaccgacaacgcggagcugaagaagacccccgaggagguggaggccaagcucaucgaccagaucgggaagcagaucaacgagauccugagcaaggacaccgacacgaagauccugaagaaguacaaggacaacgaccugaaggagaccgacaccgacaagaucacccgcgaccucgcccgggacaaggaggagaucgagaagcugauccuggagcagaagcagcgcgccgacgacuacaacuacaccuccagcacgaaguucaacaucgacaagucccggaagcgcaagcaccuccuguucaacgcggagaagggcaagaucggcguguggcuggccaacgacaucaagcgguucauguucaaggagagcaagagcaaguggaagggguaccagcacaucgagcuccagaagcuguucgccuacuucgacaccuccaagagcgaccuggagcucauccuguccaacauggugauggucaaggacuaccccaucgagcugaucgaccucgugaagaagucccgcacccugguggacuuccugaacaaguaccucgaggcccggcuggaguacaucgagaacgucaucacccgcgugaagaacagcaucggcacgccgcaguucaagaccgugcggaaggagugcuucaccuuccugaagaaguccaacuacaccgucgugagccucgacaagcaggucgagcgcauccugagcaugccccuguucaucgagcggggguucauggacgacaagcccacgaugcucgagggcaaguccuacaagcagcacaaggagaaguucgccgacugguucgugcacuacaaggagaacagcaacuaccagaacuucuacgacaccgagguguacgagaucaccaccgaggacaagcgcgagaaggcgaaggugacgaagaagaucaagcagcagcagaagaacgacgucuucacccugaugauggugaacuacaugcuggaggaggugcucaagcuguccagcaacgaccggcugucccucaacgagcuguaccagaccaaggaggagcgcaucgucaacaagcaggucgccaaggacacccaggagcgcaacaagaacuacaucuggaacaaggugguggaccugcagcucugcgacgggcuggugcacaucgacaacgugaagcugaaggacaucggcaacuuccggaaguacgagaacgacagccgcgucaaggaguuccucacguaccaguccgacaucguguggagcgccuaccuguccaacgagguggacagcaacaagcuguacgucaucgagcggcagcucgacaacuacgagagcauccgcuccaaggagcugcugaaggaggugcaggagaucgagugcagcguguacaaccaggucgccaacaaggagucccucaagcagagcggcaacgagaacuucaagcaguacgugcugcaggggcugcuccccaucggcauggacgugcgggagaugcugauccuguccaccgacgucaaguucaagaaggaggagaucauccagcucgggcaggccggcgagguggagcaggaccuguacagccugaucuacauccgcaacaaguucgcgcacaaccagcucccgaucaaggaguucuucgacuucugcgagaacaacuaccgguccaucagcgacaacgaguacuacgccgaguacuacauggagaucuuccgcuccaucaaggagaaguacgccaacuga

SEQ ID NO: 11187 - RNA, 3465 nt, Artificial Sequence
  Cas13b variant__Paludibacter propionicigenes__WP_013446107.1__Cas13b
augaagaccagcgccaacaacaucuacuucaacggcaucaacuccuucaagaagaucuucgacagcaagggggccaucgcgcccaucgccgagaaguccugccgcaacuucgacaucaaggcccagaacgacgugaacaaggagcagcggauccacuacuucgccgucggccacaccuucaagcagcuggacacggagaaccucuucgaguacgugcuggacgagaaccugcgcgccaagcggccgacccgcuucaucagccuccagcaguucgacaaggaguucaucgagaacaucaagcggcugaucuccgacauccgcaacaucaacagccacuacauccaccgguucgacccccugaagaucgacgcggugcccaccaacaucaucgacuuccucaaggaguccuucgagcuggccgucauccagaucuaccugaaggagaaggggaucaacuaccuccaguucagcgagaacccccacgccgaccagaagcugguggccuuccugcacgacaaguuccucccgcuggacgagaagaagaccuccaugcugcagaacgagacgccccagcucaaggaguacaaggaguaccgcaaguacuucaagacccugagcaagcaggcggccaucgaccagcugcuguucgccgagaaggagaccgacuacaucuggaaccuguucgacucccaccccgugcugaccaucagcgccggcaaguaccucuccuucuacagcugccuguuccugcucuccauguuccuguacaagagcgaggccaaccagcugaucuccaagaucaagggguucaagaagaacacgaccgaggaggagaaguccaagcgggagaucuucaccuucuucagcaagcgcuucaacagcauggacaucgacagcgaggagaaccagcucgucaaguuccgggaccugauccuguaccucaaccacuaccccguggcguggaacaaggaccuggagcuggacuccagcaacccggccaugaccgacaagcucaaguccaagaucaucgagcuggagaucaaccgcagcuucccccuguacgagggcaacgagcgguucgccacguucgccaaguaccagaucuggggcaagaagcaccucgggaaguccaucgagaaggaguacaucaacgccagcuucaccgacgaggagaucaccgcguacaccuacgagacggacacgugccccgagcugaaggacgcccacaagaagcuggccgaccucaaggccgccaagggccuguucgggaagcgcaaggagaagaacgaguccgacaucaagaagaccgagaccagcauccgggagcugcagcacgagcccaacccgaucaaggacaagcucauccagcgcaucgagaagaaccugcugaccguguccuacggccggaaccaggaccgcuucauggacuucagcgcgcgguuccucgccgagaucaacuacuucgggcaggacgccuccuucaagauguaccacuucuacgccaccgacgagcagaacagcgagcuggagaaguacgagcugcccaaggacaagaagaaguacgacucccucaaguuccaccagggcaagcugguccacuucaucagcuacaaggagcaccugaagcgcuacgaguccugggacgacgccuucgugaucgagaacaacgcgauccagcugaagcucagcuucgacggcguggagaacaccgucaccauccagcgggcccugcugaucuaccuccuggaggacgcccugcgcaacauccagaacaacacggccgagaacgcggggaagcagcuccugcaggaguacuacucccacaacaaggccgaccugagcgccuucaagcagauccucacccagcaggacuccaucgagccccagcagaagaccgaguucaagaagcugcugccccgccggcuccugaacaacuacagcccggccaucaaccaccuccagacgccccacagcucccucccccugauccuggagaaggcccuccuggcggagaagcgcuacugcagccugguggugaaggccaaggccgagggcaacuacgacgacuucaucaagcggaacaaggggaagcaguucaagcuccaguucauccgcaaggccuggaaccugauguacuuccggaacuccuaccugcagaacguccaggccgcgggccaccacaagagcuuccacaucgagcgcgacgaguucaacgacuucucccgguacauguucgccuucgaggagcucagccaguacaaguacuaccugaacgagauguucgagaagaagggcuucuucgagaacaacgaguucaagauccuguuccaguccgggaccagccucgagaaccuguacgagaagaccaagcagaaguucgagaucuggcuggccuccaacaccgccaagaccaacaagcccgacaacuaccaccucaacaacuacgagcagcaguucagcaaccagcuguucuucaucaaccugucccacuucaucaacuaccucaagagcacgggcaagcugcagaccgacgccaacgggcagaucaucuacgaggcgcugaacaacgugcaguaccucaucccggaguacuacuacaccgacaagcccgagcgcuccgagagcaaguccggcaacaagcuguacaacaagcugaaggccaccaagcucgaggacgcccugcuguacgagauggccaugugcuaccucaaggcggacaagcagaucgccgacaaggccaagcaccccaucacgaagcugcugaccagcgacguggaguucaacaucaccaacaaggaggggauccagcucuaccaccuccugguccccuucaagaagaucgacgccuucaucggccugaagaugcacaaggagcagcaggacaagaagcacccgaccuccuuccuggccaacaucgugaacuaccuggagcucgugaagaacgacaaggacauccggaagaccuacgaggcguucagcacgaaccccgucaagcgcacccugaccuacgacgaccuggccaagaucgacggccaccucaucagcaaguccaucaaguucaccaacgugacgcuggagcuggagcgguacuucaucuucaaggagagccucaucgugaagaaggggaacaacaucgacuucaaguacaucaagggccugcgcaacuacuacaacaacgagaagaagaagaacgaggggauccggaacaaggccuuccacuucggcauccccgacuccaagagcuacgaccagcugauccgcgacgccgaggucauguucaucgccaacgaggugaagcccacccacgcgaccaaguacaccgaccucaacaagcagcugcacacggucugcgacaagcugauggagaccgugcacaacgacuacuucuccaaggagggggacggcaagaagaagcgggaggccgccggccagaaguacuucgagaacaucaucagcgccaaguga

SEQ ID NO: 11188 - RNA, 3396 nt, Artificial Sequence
  Cas13b variant__Phaeodactylibacter xiamenensis__WP_044218239.1__Cas13b
augaccaacacccccaagcgccggacgcugcaccgccacccgagcuacuucggcgccuuccucaacaucgcccggcacaacgcguucaugaucauggagcaccuguccaccaaguacgacauggaggacaagaacacccuggacgaggcccagcuccccaacgccaagcuguucgggugccugaagaagcgcuacggcaagcccgacgugaccgagggggucagccgggaccuccgccgguacuuccccuuccugaacuacccgcuguuccuccaccuggagaagcagcagaacgccgagcaggccgcgacguacgacaucaaccccgaggacaucgaguucacccugaagggcuucuuccgccuccugaaccagaugcggaacaacuacucccacuacaucagcaacaccgacuacgggaaguucgacaagcugcccgugcaggacaucuacgaggccgccaucuuccgccuccuggaccggggcaagcacaccaagcgcuucgacguguucgaguccaagcacacgcggcaccuggagagcaacaacuccgaguaccgcccccggagccucgccaacuccccggaccacgagaacaccgucgcguucgugaccugccuguuccuggagcgcaaguacgccuuccccuuccucagccggcuggacugcuuccgcuccaccaacgacgccgccgagggcgacccccugauccggaaggccagccacgagugcuacacgauguucugcugccgccucccccagccgaagcuggaguccagcgacauccugcucgacauggugaacgagcuggggcggugccccuccgcgcuguacaaccuccugagcgaggaggaccaggcccgcuuccacaucaagcgcgaggagaucaccggcuucgaggaggaccccgacgaggagcuggagcaggagaucguccucaagcggcacuccgaccgcuuccccuacuucgcccugcgguacuucgacgacaccgaggccuuccagacccugcgcuucgacguguaccucgggcgguggcgcacgaagccgguguacaagaagcggaucuacggccaggagcgcgaccggguccugacccagagcauccgcaccuucacccggcugucccgccuccugcccaucuacgagaacgugaagcacgacgccgugcggcagaacgaggaggacgggaagcuggucaaccccgacgugacgagccaguuccacaagagcuggauccagaucgaguccgacgaccgcgcguuccucagcgaccggaucgagcacuucagcccccacuacaacuucggcgaccaggugaucggccugaaguucaucaacccggaccgcuacgccgccauccagaacgucuuccccaagcugcccggggaggagaagaaggacaaggacgccaagcucgugaacgagaccgccgacgcgaucaucuccacccacgagauccggucccuguuccuguaccacuaccucagcaagaagcccaucuccgccggcgacgagcgccgguucauccagguggacaccgagacguucaucaagcaguacaucgacaccaucaagcuguucuucgaggacaucaagagcggggagcugcagccgaucgccgacccgcccaacuaccagaagaacgagccccugcccuacguccgcggcgacaaggagaagacccaggaggagcgcgcccaguaccgggagcgccagaaggagaucaaggagcggcgcaaggagcucaacacccugcugcagaaccgguacggccucuccauccaguacauccccagccgccugcgggaguaccugcucggguacaagaaggugcccuacgagaagcuggcccugcagaagcuccgcgcgcagcggaaggaggugaagaagcgcaucaaggacaucgagaagaugcggacgccgcgcgucggcgagcaggccaccuggcuggccgaggacaucguguuccugaccccgcccaagaugcacacccccgagcggaagacgaccaagcacccccagaagcucaacaacgaccaguuccgcaucaugcaguccagccuggccuacuucuccgugaacaagaaggcgaucaagaaguucuuccagaaggagaccgggaucggccugagcaaccgggagaccucccaccccuuccucuaccgcaucgacgucgggcggugccgcggcauccuggacuucuacacgggcuaccugaaguacaagauggacuggcucgacgacgccaucaagaagguggacaaccggaagcacgggaagaaggaggccaagaaguacgagaaguaccugcccagcuccauccagcacaagacgccccuggagcucgacuacacccgccugccggucuaccugccccggggccucuucaagaaggccaucgugaaggcccuggcggcccacgccgacuuccagguggagcccgaggaggacaacgucaucuucugccuggaccagcuccuggacggggacacccaggacuucuacaacuggcagcgcuacuaccgcagcgcccugaccgagaaggagaccgacaaccagcucgugcuggcccaccccuacgcggagcagauccugggcaccaucaagacccucgaggggaagcagaagaacaacaagcugggcaacaaggccaagcagaagaucaaggacgagcugaucgaccucaagcgggccaagcgccggcugcuggaccgcgagcaguaccuccgggccgugcaggccgaggaccgcgcgcuguggcugaugauccaggagcggcagaagcagaaggccgagcacgaggagaucgccuucgaccagcucgaccugaagaacaucaccaagauccugacggaguccaucgacgcccgccuccggaucccggacaccaaggucgacaucaccgacaagcugccccugcgccgguacggcgaccuccgccggguggcgaaggaccgccggcuggugaaccuggccagcuacuaccacgucgccgggcucagcgagauccccuacgaccuggugaagaaggagcuggaggaguacgaccgccggcgcguggccuucuucgagcacgucuaccaguucgagaaggagguguacgaccgguacgccgcggagcuccgcaacgagaaccccaagggcgaguccaccuacuucagccacugggaguacguggccgucgccgugaagcacuccgccgacacgcacuucaacgagcuguucaaggagaaggugaugcagcugcgcaacaaguuccaccacaacgaguucccguacuucgacuggcuccugcccgaggucgagaaggccagcgcggcccuguacgccgaccggguguucgacguggccgagggguacuaccagaagaugcgcaagcucaugcggcaguga

SEQ ID NO: 11189 - RNA, 3408 nt, Artificial Sequence
  Cas13b variant__Porohyromonas gingivalis__WP_012458151.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccguguucuucaagcccgacgacuucgugcuggccaagaaccgcaaggagcagcugaucuccgucgcggacgggaaggagugccucaccgugagcggcuucgccuucuucaucugccuguuccuggaccgggagcaggccuccgggaugcucagccgcauccggggcuucaagcgcaccgacgagaacugggcccgggcggugcacgagacguucugcgaccugugcauccgccacccccacgaccggcuggagagcuccaacaccaaggaggcccuccugcuggacaugcucaacgagcugaaccgcugcccccggauccuguacgacaugcucccggaggaggagcgcgcccaguuccugcccgcccuggacgagaacagcaugaacaaccucuccgagaacagccuggacgaggagucccgccugcucugggacgggagcuccgacugggccgaggcgcugaccaagcggauccgccaccaggaccgguuccccuaccugaugcuccgcuucaucgaggagauggaccugcugaagggcauccgguuccgcgucgaccucggcgagaucgagcuggacagcuacuccaagaagguggggcggaacggcgaguacgaccgcaccaucacggaccacgcccuggccuucgggaagcucagcgacuuccagaacgaggaggaggugucccggaugaucagcggcgaggccuccuaccccguccgcuucagccuguucgccccgcgguacgcgaucuacgacaacaagaucggcuacugccacaccuccgaccccguguaccccaagagcaagaccggggagaagcgcgcccuguccaacccccagagcaugggcuucaucuccgugcacgaccugcggaagcuccugcugauggagcuccugugcgaggggagcuucagccgcaugcaguccgacuuccugcggaaggccaaccgcauccucgacgagaccgccgagggcaagcugcaguucagcgcccuguucccggagaugcggcaccgcuucaucccgccccagaaccccaaguccaaggaccggcgcgagaaggcggagacgacccucgagaaguacaagcaggagaucaaggggcgcaaggacaagcugaacagccagcugcucuccgccuucgacauggaccagcggcagcugcccagccgccugcucgacgaguggaugaacauccggcccgccucccacagcgucaagcugcgcaccuacgugaagcagcugaacgaggacugccggcuccgccugcggaaguuccgcaaggacggcgacggcaaggcccgggccaucccccuggugggggagauggcgaccuuccucucccaggacaucguccgcaugaucaucagcgaggagacgaagaagcugaucaccuccgccuacuacaacgagaugcagcggagccuggcccaguacgccggcgaggagaaccgccggcaguuccgcgcgaucguggccgagcuccggcugcuggaccccuccagcgggcacccguuccucuccgccaccauggagaccgcccaccgcuacacggagggcuucuacaagugcuaccuggagaagaagcgggaguggcuggccaagaucuucuaccgccccgagcaggacgagaacaccaagcggcgcaucagcguguucuucguccccgacggggaggcgcggaagcuccugccccugcucauccgccgccggaugaaggagcagaacgaccugcaggacuggauccgcaacaagcaggcccacccgaucgaccugcccucccaccucuucgacagcaaggugauggagcugcugaaggucaaggacggcaagaagaaguggaacgaggccuucaaggacugguggagcaccaaguaccccgacggcaugcagccguucuacgggcuccggcgcgagcugaacauccacggcaaguccgugagcuacauccccuccgacgggaagaaguucgccgacugcuacacccaccugauggagaagacggugcgggacaagaagcgcgagcuccggaccgccggcaagcccgugcccccggaccuggcggccgacaucaagcgcagcuuccaccgggccgucaacgagcgcgaguucaugcugcggcucgugcaggaggacgaccgccugaugcugauggccaucaacaagaugaugaccgaccgggaggaggacauccuccccgggcugaagaacaucgacuccauccuggacgaggagaaccaguucagccucgccguccacgcgaaggugcuggagaaggagggcgagggcggggacaacucccugagccucgugcccgccaccaucgagaucaaguccaagcgcaaggacuggagcaaguacauccgguaccgcuacgaccggcgcguccccggccugaugucccacuucccggagcacaaggccacgcuggacgaggugaagacccuccugggggaguacgaccggugccgcaucaagaucuucgacugggccuucgcgcuggagggcgccaucaugagcgaccgcgaccucaagcccuaccugcacgaguccagcucccgggagggcaagagcggggagcacuccacccuggugaagaugcucgucgagaagaagggcugccugacccccgacgagagccaguaccugauccucauccgcaacaaggccgcccacaaccaguuccccugcgccgcggagaugccgcugaucuaccgggacguguccgccaagguggggagcaucgagggcagcuccgccaaggaccugcccgaggggagcucccucgucgacagccuguggaagaaguacgagaugaucauccgcaagauccugcccauccucgaccccgagaaccgguucuucggcaagcugcugaacaacaugucccagccgaucaacgaccucuga

SEQ ID NO: 11190 - RNA, 3408 nt, Artificial Sequence
  Cas13b variant__Porohyromonas gingivalis__ERJ81987.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccgacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccagagcaugggcuucaucuccgugcacgaccuccggaagcugcugcucauggagcugcugugcgaggggagcuucagccgcaugcaguccggcuuccuccggaaggccaaccgcauccuggacgagaccgccgaggggaagcugcaguucagcgcccucuucccggagaugcggcaccgcuucaucccgccccagaaccccaaguccaaggaccggcgcgagaaggcggagacgacccuggagaaguacaagcaggagaucaagggccgcaaggacaagcugaacagccagcuccuguccgccuucgacaugaaccagcggcagcugcccagccgccuccuggacgaguggaugaacauccggcccgccucccacagcgugaagcugcgcaccuacgucaagcagcucaacgaggacugccggcugcgccugcggaaguuccgcaaggacggcgacgggaaggcccgggccaucccccucgugggcgagauggcgaccuuccugucccaggacaucgugcgcaugaucaucagcgaggagacgaagaagcugaucaccuccgccuacuacaacgagaugcagcggagccucgcccaguacgccggggaggagaaccgccggcaguuccgcgcgaucgucgccgagcugcaccuccuggaccccuccagcggccacccguuccuguccgccaccauggagaccgcccaccgguacacggaggacuucuacaagugcuaccuggagaagaagcgcgaguggcucgccaagaccuucuaccggcccgagcaggacgagaacaccaagcgccggaucagcguguucuucgugcccgacggggaggcgcgcaagcugcugccccuccugauccggcgccgcaugaaggagcagaacgaccugcaggacuggauccggaacaagcaggcccacccgaucgaccuccccucccaccuguucgacagcaagaucauggagcugcucaaggucaaggacggcaagaagaaguggaacgaggccuucaaggacugguggagcaccaaguaccccgacggcaugcagccguucuacgggcugcgccgggagcugaacauccacggcaaguccgugagcuacauccccuccgacgggaagaaguucgccgacugcuacacgcaccucauggagaagaccguccaggacaagaagcgcgagcugcggaccgccggcaagcccgugcccccggaccuggcggccgacaucaagcgcagcuuccaccgggccgugaacgagcgcgaguucaugcuccggcugguccaggaggacgaccgccugaugcucauggccaucaacaagaugaugaccgaccgggaggaggacauccugcccgggcugaagaacaucgacuccauccucgacgaggagaaccaguucagccuggccgugcacgcgaaggugcuggagaaggagggcgagggcggggacaacucccucagccugguccccgccacgaucgagaucaaguccaagcgcaaggacuggagcaaguacauccgguaccgcuacgaccggcgcgugcccggccugaugucccacuucccggagcacaaggccacccucgacgaggugaagacccugcugggggaguacgaccggugccgcaucaagaucuucgacugggccuucgcgcucgagggcgccaucaugagcgaccgggaccugaagcccuaccugcacgaguccagcucccgcgagggcaagagcggggagcacuccacccucgucaagaugcugguggagaagaagggcugccugacgcccgacgagagccaguaccucauccugauccgcaacaaggccgcccacaaccaguuccccugcgccgcggagaugccgcugaucuaccgggacguguccgccaaggucgggagcaucgagggcagcuccgccaaggaccuccccgaggggagcucccugguggacagccuguggaagaaguacgagaugaucauccgcaagauccuccccauccuggaccacgagaaccgguucuucggcaagcugcucaacaacaugucccagcccaucaacgaccuguga

SEQ ID NO: 11191 - RNA, 3408 nt, Artificial Sequence
  Cas13b variant__Porohyromonas gingivalis__ERJ65637.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccgacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccggagcaugggcuucaucuccgugcacgaccuccgcaagcugcugcucauggagcugcugugcgaggggagcuucagccggaugcaguccgacuuccuccgcaaggccaaccggauccuggacgagaccgccgagggcaagcugcaguucagcgcccucuucccggagaugcgccaccgguucaucccgccccagaaccccaaguccaaggaccgccgcgagaaggcggagacgacccuggagaaguacaagcaggagaucaaggggcggaaggacaagcugaacagccagcuccuguccgccuucgacauggaccagcgccagcugcccagccggcuccuggacgaguggaugaacauccgccccgccucccacagcgugaagcugcggaccuacgucaagcagcucaacgaggacugccgccugcggcugcagaaguuccgcaaggacggcgacggcaaggcccgggccaucccccucgugggggagauggcgaccuuccugucccaggacaucgugcgcaugaucaucagcgaggagacgaagaagcugaucaccuccgccuacuacaacgagaugcagcggagccucgcccaguacgccggcgaggagaaccgccaccaguuccgggcgaucgucgccgagcugcgccugcucgaccccuccagcgggcacccguuccuguccgccaccauggagaccgcccaccgguacacggaggacuucuacaagugcuaccuggagaagaagcgcgaguggcucgccaagaccuucuaccggcccgagcaggacgagaacaccaagcgccggaucagcguguucuucgugcccgacggcgaggcgcgcaagcugcugccccuccugauccggcgccgcaugaaggagcagaacgaccugcaggacuggauccggaacaagcaggcccacccgaucgaccuccccucccaccuguucgacagcaagaucauggagcugcucaaggucaaggacgggaagaagaaguggaacgaggccuucaaggacugguggagcaccaaguaccccgacggcaugcagccguucuacggccugcgccgggagcugaacauccacgggaaguccgugagcuacauccccuccgacggcaagaaguucgccgacugcuacacgcaccucauggagaagaccguccaggacaagaagcgcgagcugcggaccgccgggaagcccgugcccccggaccuggcggccgacaucaagcgcagcuuccaccgggccgugaacgagcgcgaguucaugcuccggcugguccaggaggacgaccgccugaugcucauggccaucaacaagaugaugaccgaccgggaggaggacauccugcccggccugaagaacaucgacuccauccucgacgaggagaaccaguucagccuggccgugcacgcgaaggugcuggagaaggagggggagggcggcgacaacucccucagccugguccccgccacgaucgagaucaaguccaagcgcaaggacuggagcaaguacauccgguaccgcuacgaccggcgcgugcccgggcugaugucccacuucccggagcacaaggccacccucgacgaggugaagacccugcugggcgaguacgaccggugccgcaucaagaucuucgacugggccuucgcgcucgagggggccaucaugagcgaccgggaccugaagcccuaccugcacgaguccagcucccgcgagggcaagagcggcgagcacuccacccucgucaagaugcugguggagaagaaggggugccugacgcccgacgagagccaguaccucauccugauccgcaacaaggccgcccacaaccaguuccccugcgccgcggagaugccgcugaucuaccgggacguguccgccaaggucggcagcaucgaggggagcuccgccaaggaccuccccgagggcagcucccugguggacagccuguggaagaaguacgagaugaucauccgcaagauccuccccauccuggaccccgagaaccgguucuucgggaagcugcucaacaacaugucccagccgaucaacgaccuguga

SEQ ID NO: 11192 - RNA, 3408 nt, Artificial Sequence
  Cas13b variant__Porohyromonas gingivalis__WP_021665475.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccaacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccagagcaugggcuucaucuccgugcacgaccuccggaagcugcugcucauggagcugcugugcgaggggagcuucagccgcaugcaguccggcuuccuccggaaggccaaccgcauccuggacgagaccgccgaggggaagcugcaguucagcgcccucuucccggagaugcggcaccgcuucaucccgccccagaaccccaaguccaaggaccggcgcgagaaggcggagacgacccuggagaaguacaagcaggagaucaagggccgcaaggacaagcugaacagccagcuccuguccgccuucgacaugaaccagcggcagcugcccagccgccuccuggacgaguggaugaacauccggcccgccucccacagcgugaagcugcgcaccuacgucaagcagcucaacgaggacugccggcugcgccugcggaaguuccgcaaggacggcgacgggaaggcccgggccaucccccucgugggcgagauggcgaccuuccugucccaggacaucgugcgcaugaucaucagcgaggagacgaagaagcugaucaccuccgccuacuacaacgagaugcagcggagccucgcccaguacgccggggaggagaaccgccggcaguuccgcgcgaucgucgccgagcugcaccuccuggaccccuccagcggccacccguuccuguccgccaccauggagaccgcccaccgguacacggaggacuucuacaagugcuaccuggagaagaagcgcgaguggcucgccaagaccuucuaccggcccgagcaggacgagaacaccaagcgccggaucagcguguucuucgugcccgacggggaggcgcgcaagcugcugccccuccugauccggcgccgcaugaaggagcagaacgaccugcaggacuggauccggaacaagcaggcccacccgaucgaccuccccucccaccuguucgacagcaagaucauggagcugcucaaggucaaggacggcaagaagaaguggaacgaggccuucaaggacugguggagcaccaaguaccccgacggcaugcagccguucuacgggcugcgccgggagcugaacauccacggcaaguccgugagcuacauccccuccgacgggaagaaguucgccgacugcuacacgcaccucauggagaagaccguccaggacaagaagcgcgagcugcggaccgccggcaagcccgugcccccggaccuggcggccgacaucaagcgcagcuuccaccgggccgugaacgagcgcgaguucaugcuccggcugguccaggaggacgaccgccugaugcucauggccaucaacaagaugaugaccgaccgggaggaggacauccugcccgggcugaagaacaucgacuccauccucgacaaggagaaccaguucagccuggccgugcacgcgaaggugcuggagaaggagggcgagggcggggacaacucccucagccugguccccgccacgaucgagaucaaguccaagcgcaaggacuggagcaaguacauccgguaccgcuacgaccggcgcgugcccggccugaugucccacuucccggagcacaaggccacccucgacgaggugaagacccugcugggggaguacgaccggugccgcaucaagaucuucgacugggccuucgcgcucgagggcgccaucaugagcgaccgggaccugaagcccuaccugcacgaguccagcucccgcgagggcaagagcggggagcacuccacccucgucaagaugcugguggagaagaagggcugccugacgcccgacgagagccaguaccucauccugauccgcaacaaggccgcccacaaccaguuccccugcgccgcggagaugccgcugaucuaccgggacguguccgccaaggucgggagcaucgagggcagcuccgccaaggaccuccccgaggggagcucccugguggacagccuguggaagaaguacgagaugaucauccgcaagauccuccccauccuggaccacgagaaccgguucuucggcaagcugcucaacaacaugucccagcccaucaacgaccuguga

SEQ ID NO: 11193 - RNA, 3408 nt, Artificial Sequence
  Cas13b variant__Porohyromonas gingivalis__WP_061156637.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccgacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccagagcaugggcuucaucuccgugcacgaccuccggaagcugcugcucauggagcugcugugcgaggggagcuucagccgcaugcaguccggcuuccuccggaaggccaaccgcauccuggacgagaccgccgaggggaagcugcaguucagcgcccucuucccggagaugcggcaccgcuucaucccgccccagaaccccaaguccaaggaccggcgcgagaaggcggagacgacccuggagaaguacaagcaggagaucaagggccgcaaggacaagcugaacagccagcuccuguccgccuucgacaugaaccagcggcagcugcccagccgccuccuggacgaguggaugaacauccggcccgccucccacagcgugaagcugcgcaccuacgucaagcagcucaacgaggacugccggcugcgccugcggaaguuccgcaaggacggcgacgggaaggcccgggccaucccccucgugggcgagauggcgaccuuccugucccaggacaucgugcgcaugaucaucagcgaggagacgaagaagcugaucaccuccgccuacuacaacgagaugcagcggagccucgcccaguacgccggggaggagaaccgccggcaguuccgcgcgaucgucgccgagcugcaccuccuggaccccuccagcggccacccguuccuguccgccaccauggagaccgcccaccgguacacggaggacuucuacaagugcuaccuggagaagaagcgcgaguggcucgccaagaccuucuaccggcccgagcaggacgagaacaccaagcgccggaucagcguguucuucgugcccgacggggaggcgcgcaagcugcugccccuccugauccggcgccgcaugaaggagcagaacgaccugcaggacuggauccggaacaagcaggcccacccgaucgaccuccccucccaccuguucgacagcaagaucauggagcugcucaaggucaaggacggcaagaagaaguggaacgaggccuucaaggacugguggagcaccaaguaccccgacggcaugcagccguucuacgggcugcgccgggagcugaacauccacggcaaguccgugagcuacauccccuccgacgggaagaaguucgccgacugcuacacgcaccucauggagaagaccguccaggacaagaagcgcgagcugcggaccgccggcaagcccgugcccccggaccuggcggccgacaucaagcgcagcuuccaccgggccgugaacgagcgcgaguucaugcuccggcugguccaggaggacgaccgccugaugcucauggccaucaacaagaugaugaccgaccgggaggaggacauccugcccgggcugaagaacaucgacuccauccucgacaaggagaaccaguucagccuggccgugcacgcgaaggugcuggagaaggagggcgagggcggggacaacucccucagccugguccccgccacgaucgagaucaaguccaagcgcaaggacuggagcaaguacauccgguaccgcuacgaccggcgcgugcccggccugaugucccacuucccggagcacaaggccacccucgacgaggugaagacccugcugggggaguacgaccggugccgcaucaagaucuucgacugggccuucgcgcucgagggcgccaucaugagcgaccgggaccugaagcccuaccugcacgaguccagcucccgcgagggcaagagcggggagcacuccacccucgucaagaugcugguggagaagaagggcugccugacgcccgacgagagccaguaccucauccugauccgcaacaaggccgcccacaaccaguuccccugcgccgcggagaugccgcugaucuaccgggacguguccgccaaggucgggagcaucgagggcagcuccgccaaggaccuccccgaggggagcucccugguggacagccuguggaagaaguacgagaugaucauccgcaagauccuccccauccuggaccccgagaaccgguucuucggcaagcugcucaacaacaugucccagccgaucaacgaccuguga

SEQ ID NO: 11194 - RNA, 3408 nt, Artificial Sequence
  Cas13b variant__Porohyromonas gingivalis__WP_023846767.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccgacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccggagcaugggcuucaucuccgugcacgaccuccgcaagcugcugcucauggagcugcugugcgaggggagcuucagccggaugcaguccgacuuccuccgcaaggccaaccggauccuggacgagaccgccgagggcaagcugcaguucagcgcccucuucccggagaugcgccaccgguucaucccgccccagaaccccaaguccaaggaccgccgcgagaaggcggagacgacccuggagaaguacaagcaggagaucaaggggcggaaggacaagcugaacagccagcuccuguccgccuucgacaugaaccagcgccagcugcccagccggcuccuggacgaguggaugaacauccgccccgccucccacagcgugaagcugcggaccuacgucaagcagcucaacgaggacugccgccugcggcugcgcaaguuccggaaggacggcgacggcaaggcccgcgccaucccccucgugggggagauggcgaccuuccugucccaggacaucgugcggaugaucaucagcgaggagacgaagaagcugaucaccuccgccuacuacaacgagaugcagcgcagccucgcccaguacgccggcgaggagaaccggcgccaguuccgggcgaucgucgccgagcugcaccuccuggaccccuccagcgggcacccguuccuguccgccaccauggagaccgcccaccgcuacacggaggacuucuacaagugcuaccuggagaagaagcgggaguggcucgccaagaccuucuaccgccccgagcaggacgagaacaccaagcggcgcaucagcguguucuucgugcccgacggcgaggcgcggaagcugcugccccuccugauccgccgccggaugaaggagcagaacgaccugcaggacuggauccgcaacaagcaggcccacccgaucgaccuccccucccaccuguucgacagcaagaucauggagcugcucaaggucaaggacgggaagaagaaguggaacgaggccuucaaggacugguggagcaccaaguaccccgacggcaugcagccguucuacggccugcggcgcgagcugaacauccacgggaaguccgugagcuacauccccuccgacggcaagaaguucgccgacugcuacacgcaccucauggagaagaccguccaggacaagaagcgggagcugcgcaccgccgggaagcccgugcccccggaccuggcggccgacaucaagcggagcuuccaccgcgccgugaacgagcgggaguucaugcuccgccugguccaggaggacgaccggcugaugcucauggccaucaacaagaugaugaccgaccgcgaggaggacauccugcccggccugaagaacaucgacuccauccucgacgaggagaaccaguucagccuggccgugcacgcgaaggugcuggagaaggagggggagggcggcgacaacucccucagccugguccccgccacgaucgagaucaaguccaagcggaaggacuggagcaaguacauccgcuaccgguacgaccgccgggugcccgggcugaugucccacuucccggagcacaaggccacccucgacgaggugaagacccugcugggcgaguacgaccgcugccggaucaagaucuucgacugggccuucgcgcucgagggggccaucaugagcgaccgcgaccugaagcccuaccugcacgaguccagcucccgcgagggcaagagcggcgagcacuccacccucgucaagaugcugguggagaagaaggggugccugacgcccgacgagagccaguaccucauccugauccggaacaaggccgcccacaaccaguuccccugcgccgcggagaugccgcugaucuaccgcgacguguccgccaaggucggcagcaucgaggggagcuccgccaaggaccuccccgagggcagcucccugguggacagccuguggaagaaguacgagaugaucauccggaagauccuccccauccuggaccccgagaaccgcuucuucgggaagcugcucaacaacaugucccagccgaucaacgaccuguga

SEQ ID NO: 11195 - RNA, 3408 nt, Artificial Sequence
  Cas13b variant__Porohyromonas gingivalis__ERJ87335.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccgacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccggagcaugggcuucaucuccgugcacgaccuccgcaagcugcugcucauggagcugcugugcgaggggagcuucagccggaugcaguccgacuuccuccgcaaggccaaccggauccuggacgagaccgccgagggcaagcugcaguucagcgcccucuucccggagaugcgccaccgguucaucccgccccagaaccccaaguccaaggaccgccgcgagaaggcggagacgacccuggagaaguacaagcaggagaucaaggggcggaaggacaagcugaacagccagcuccuguccgccuucgacauggaccagcgccagcugcccagccggcuccuggacgaguggaugaacauccgccccgccucccacagcgugaagcugcggaccuacgucaagcagcucaacgaggacugccgccugcggcugcagaaguuccgcaaggacggcgacggcaaggcccgggccaucccccucgugggggagauggcgaccuuccugucccaggacaucgugcgcaugaucaucagcgaggagacgaagaagcugaucaccuccgccuacuacaacgagaugcagcggagccucgcccaguacgccggcgaggagaaccgccaccaguuccgggcgaucgucgccgagcugcgccugcucgaccccuccagcgggcacccguuccuguccgccaccauggagaccgcccaccgguacacggaggacuucuacaagugcuaccuggagaagaagcgcgaguggcucgccaagaccuucuaccggcccgagcaggacgagaacaccaagcgccggaucagcguguucuucgugcccgacggcgaggcgcgcaagcugcugccccuccugauccggcgccgcaugaaggagcagaacgaccugcaggacuggauccggaacaagcaggcccacccgaucgaccuccccucccaccuguucgacagcaaggucauggagcugcucaaggugaaggacgggaagaagaaguggaacgaggccuucaaggacugguggagcaccaaguaccccgacggcaugcagccguucuacggccugcgccgggagcugaacauccacgggaaguccgucagcuacauccccuccgacggcaagaaguucgccgacugcuacacgcaccucauggagaagaccgugcgcgacaagaagcgggagcugcgcaccgccgggaagcccgugcccccggaccuggcggccuacaucaagcggagcuuccaccgcgccgucaacgagcgggaguucaugcuccgccuggugcaggaggacgaccggcugaugcucauggccaucaacaagaucaugaccgaccgcgaggaggacauccugcccggccugaagaacaucgacuccauccucgacaaggagaaccaguucagccuggccgugcacgcgaagguccuggagaaggagggggagggcggcgacaacucccucagccuggugcccgccacgaucgagaucaaguccaagcggaaggacuggagcaaguacauccgcuaccgguacgaccgccgggugcccgggcugaugucccacuucccggagcacaaggccacccucgacgaggucaagacccugcugggcgaguacgaccgcugccggaucaagaucuucgacugggccuucgcgcucgagggggccaucaugagcgaccgcgaccugaagcccuaccugcacgaguccagcucccgcgagggcaagagcggcgagcacuccacccucgugaagaugcugguggagaagaaggggugccugacgcccgacgagagccaguaccucauccugauccggaacaaggccgcccacaaccaguuccccugcgccgcggagaucccgcugaucuaccgcgacgucuccgccaaggugggcagcaucgaggggagcuccgccaaggaccuccccgagggcagcucccugguggacagccuguggaagaaguacgagaugaucauccggaagauccuccccauccuggaccccgagaaccgcuucuucgggaagcugcucaacaacaugucccagccgaucaacgaccuguga

SEQ ID NO: 11196 - RNA, 3408 nt, Artificial Sequence
  Cas13b variant__Porohyromonas gingivalis__WP_005873511.1__Cas13b
augaacaccgugcccgccagcgagaacaagggccagucccgcaccgucgaggacgacccgcaguacuucgggcuguaccucaaccuggcccgggagaaccugaucgagguggagagccacgugcgcaucaaguucggcaagaagaagcucaacgaggagucccugaagcagagccugcucugcgaccaccuccuguccgucgaccgguggacgaagguguacgggcacagccgccgguaccugcccuuccugcacuacuucgaccccgacucccagaucgagaaggaccacgacagcaagaccggcguggaccccgacuccgcgcagcgccugauccgggagcucuacagccugcuggacuuccuccgcaacgacuucucccacaaccggcuggacgggaccaccuucgagcaccuggaggucagcccggacaucuccagcuucaucacgggcaccuacucccucgccugcggccgcgcccagagccgguucgccgacuucuucaagcccgacgacuucgugcuggccaagaaccgcaaggagcagcugaucuccguggcggacgggaaggagugccucaccgucagcggccuggccuucuucaucugccuguuccucgaccgggagcaggccuccgggaugcugagccgcauccggggcuucaagcgcaccgacgagaacugggcccgggcggugcacgagacguucugcgaccugugcauccgccacccccacgaccggcucgagagcuccaacaccaaggaggcccugcugcucgacaugcugaacgagcugaaccgcugcccccggauccucuacgacaugcugccggaggaggagcgcgcccaguuccugcccgcccucgacgagaacagcaugaacaaccuguccgagaacagccugaacgaggagucccgccuccugugggacgggagcuccgacugggccgaggcgcugaccaagcggauccgccaccaggaccgguuccccuaccucaugcugcgcuucaucgaggagauggaccugcucaagggcauccgguuccgcguggaccugggcgagaucgagcuggacagcuacuccaagaaggucgggcggaacggcgaguacgaccgcaccaucacggaccacgcccucgccuucgggaagcugagcgacuuccagaacgaggaggaggugucccggaugaucagcggcgaggccuccuaccccgugcgcuucagccuguucgccccgcgguacgcgaucuacgacaacaagaucggcuacugccacaccuccgaccccgucuaccccaagagcaagaccggggagaagcgcgcccuguccaacccccagagcaugggcuucaucuccgugcacaaccuccggaagcugcugcucauggagcugcugugcgaggggagcuucagccgcaugcaguccgacuuccuccggaaggccaaccgcauccuggacgagaccgccgagggcaagcugcaguucagcgcccucuucccggagaugcggcaccgcuucaucccgccccagaaccccaaguccaaggaccggcgcgagaaggcggagacgacccuggagaaguacaagcaggagaucaaggggcgcaaggacaagcugaacagccagcuccuguccgccuucgacaugaaccagcggcagcugcccagccgccuccuggacgaguggaugaacauccggcccgccucccacagcgugaagcugcgcaccuacgucaagcagcucaacgaggacugccggcugcgccugcggaaguuccgcaaggacggcgacggcaaggcccgggccaucccccucgugggggagauggcgaccuuccugucccaggacaucgugcgcaugaucaucagcgaggagacgaagaagcugaucaccuccgccuacuacaacgagaugcagcggagccucgcccaguacgccggcgaggagaaccgccggcaguuccgcgcgaucgucgccgagcugcaccuccuggaccccuccagcgggcacccguuccuguccgccaccauggagaccgcccaccgguacacggaggacuucuacaagugcuaccuggagaagaagcgcgaguggcucgccaagaccuucuaccggcccgagcaggacgagaacaccaagcgccggaucagcguguucuucgugcccgacggcgaggcgcgcaagcugcugccccuccugauccggcgccgcaugaaggagcagaacgaccugcaggacuggauccggaacaagcaggcccacccgaucgaccuccccucccaccuguucgacagcaagaucauggagcugcucaaggucaaggacgggaagaagaaguggaacgaggccuucaaggacugguggagcaccaaguaccccgacggcaugcagccguucuacggccugcgccgggagcugaacauccacgggaaguccgugagcuacauccccuccgacggcaagaaguucgccgacugcuacacgcaccucauggagaagaccguccaggacaagaagcgcgagcugcggaccgccgggaagcccgugcccccggaccuggcggccgacaucaagcgcagcuuccaccgggccgugaacgagcgcgaguucaugcuccggcugguccaggaggacgaccgccugaugcucauggccaucaacaagaugaugaccgaccgggaggaggacauccugcccggccugaagaacaucgacuccauccucgacgaggagaaccaguucagccuggccgugcacgcgaaggugcuggagaaggagggggagggcggcgacaacucccucagccugguccccgccacgaucgagaucaaguccaagcgcaaggacuggagcaaguacauccgguaccgcuacgaccggcgcgugcccgggcugaugucccacuucccggagcacaaggccacccucgacgaggugaagacccugcugggcgaguacgaccggugccgcaucaagaucuucgacugggccuucgcgcucgagggggccaucaugagcgaccgggaccugaagcccuaccugcacgaguccagcucccgcgagggcaagagcggcgagcacuccacccucgucaagaugcugguggagaagaaggggugccugacgcccgacgagagccaguaccucauccugauccgcaacaaggccgcccacaaccaguuccccugcgccgcggagaugccgcugaucuaccgggacguguccgccaaggucggcagcaucgaggggagcuccgccaaggaccuccccgagggcagcucccugguggacagccuguggaagaaguacgagaugaucauccgcaagauccuccccauccuggaccccgagaaccgguucuucgggaagcugcucaacaacaugucccagccgaucaacgaccuguga

SEQ ID NO: 11197 - RNA, 3408 nt, Artificial Sequence
  Cas13b variant__Porohyromonas gulae__WP_039445055.1__Cas13b
augaacaccgugcccgccaccgagaacaagggccagagccgcacggucgaggacgacccgcaguacuucgggcuguaccucaaccuggcccgggagaaccugaucgagguggagucccacgugcgcaucaaguucggcaagaagaagcucaacgaggagagccugaagcagucccugcucugcgaccaccuccugagcaucgaccgguggaccaaggucuacgggcacucccgccgguaccugcccuuccugcacugcuucgaccccgacagcggcaucgagaaggaccacgacuccaagaccgggguggaccccgacagcgcgcagcgccugauccgggagcucuacucccugcuggacuuccuccgcaacgacuucagccacaaccggcuggacggcaccacguucgagcaccugaagguguccccggacaucagcuccuucaucaccggcgccuacaccuucgccugcgagcgcgcccagagccgguucgccgacuucuucaagcccgacgacuuccuccuggcgaagaaccgcaaggagcagcugaucuccgucgccgacgggaaggagugccucaccgugagcggcuucgccuucuucaucugccuguuccuggaccgggagcaggccuccgggaugcucagccgcauccggggcuucaagcgcacggacgagaacugggcgcgggccgugcacgagaccuucugcgaccugugcauccgccacccccacgaccggcuggaguccagcaacaccaaggaggcccuccugcuggacaugcucaacgagcugaaccgcugcccccggauccuguacgacaugcucccggaggaggagcgcgcccaguuccugcccgcccuggacgagaacagcaugaacaaccucuccgagaacagccugaacgaggagucccgccugcucugggacgggagcuccgacugggcggaggcccugaccaagcggauccgccaccaggaccgguuccccuaccugaugcuccgcuucaucgaggagauggaccugcugaagggcauccgguuccgcgucgaccucggcgagaucgagcuggacagcuacuccaagaagguggggcggaacggcgaguacgaccgcacgaucaccgaccacgcccuggccuucgggaagcucagcgacuuccagaacgaggaggaggugucccggaugaucagcggcgaggccuccuaccccguccgcuucagccuguucgcgccgcgguacgccaucuacgacaacaagaucggcuacugccacaccuccgaccccguguaccccaagagcaagaccggggagaagcgcgcccuguccaacccccagagcaugggcuucaucuccgugcacgaccugcggaagcuccugcugauggagcuccugugcgaggggagcuucucccgcaugcagagcgacuuccugcggaaggccaaccgcauccucgacgagacggccgagggcaagcugcaguucagcgcgcuguucccggagaugcggcaccgcuucaucccgccccagaaccccaaguccaaggaccggcgcgagaaggccgagaccacccucgagaaguacaagcaggagaucaaggggcgcaaggacaagcugaacagccagcugcucuccgccuucgacaugaaccagcggcagcugcccagccgccugcucgacgaguggaugaacauccggcccgccucccacagcgucaagcugcgcaccuacgugaagcagcugaacgaggacugccggcuccgccugcggaaguuccgcaaggacggcgacggcaaggcccgggcgaucccccuggugggggagauggccacguuccucucccaggacaucguccgcaugaucaucagcgaggagaccaagaagcugaucaccuccgccuacuacaacgagaugcagcggagccuggcccaguacgcgggcgaggagaaccgccggcaguuccgcgccaucguggccgagcuccaccuccuggaccccuccagcgggcacccguuccuguccgccaccauggagacggcccaccgguacaccgaggacuucuacaagugcuaccuggagaagaagcgcgaguggcuggcgaagaccuucuaccggcccgagcaggacgagaacaccaagcgccggaucagcguguucuucguccccgacggcgaggcccgcaagcuccugccccugcucauccggcgccgcaugaaggagcagaacgaccugcaggacuggauccggaacaagcaggcccacccgaucgaccugcccucccaccucuucgacagcaagaucauggagcugcugaaggugaaggacgggaagaagaaguggaacgaggccuucaaggacuggugguccacgaaguaccccgacggcaugcagccguucuacggccuccgccgggagcugaacauccacggcaagagcgugagcuacauccccuccgacgggaagaaguucgccgacugcuacacccaccugauggagaagaccguccgcgacaagaagcgggagcuccgcaccgcggggaagcccgugcccccggaccuggccgccuacaucaagcggagcuuccaccgcgccgucaacgagcgggaguucaugcugcgccucgugcaggaggacgaccggcugaugcugauggccaucaacaagaugaugacggaccgcgaggaggacauccuccccggccugaagaacaucgacuccauccuggacgaggagaaccaguucagccucgcggugcacgccaagguccuggagaaggagggggagggcggcgacaacucccugagccucgugcccgccaccaucgagaucaaguccaagcggaaggacuggagcaaguacauccgcuaccgguacgaccgccgggugcccgggcugaugucccacuucccggagcacaaggccacccuggacgaggucaagacccuccugggcgaguacgaccgcugccggaucaagaucuucgacugggcguucgcccuggagggggccaucaugagcgaccgcgaccucaagcccuaccugcacgaguccagcucccgcgagggcaagagcggcgagcacuccacgcuggugaagaugcucguggagaagaaggggugccugacccccgacgagagccaguaccugauccucauccggaacaaggccgcccacaaccaguuccccugcgcggccgagaugccgcugaucuaccgcgacgucuccgccaaggugggcagcaucgagggguccagcgccaaggaccugcccgagggcagcucccucguggacagccuguggaagaaguacgagaugaucauccggaagauccugcccauccucgaccacgagaaccgcuucuucgggaagcugcugaacaacaugucccagcccaucaacgaccucuga

SEQ ID NO: 11198 - RNA, 3528 nt, Artificial Sequence
  Cas13b variant__Porphyromonas gingivalis__WP_052912312.1__Cas13b
augaccgagcagaacgagaagcccuacaacggcaccuacuacacgcuggaggacaagcacuucugggccgccuucuucaaccucgcgcgccacaacgccuacaucacccuggcccacaucgaccggcagcuggccuacagcaaggccgacaucaccaacgacgaggacauccucuucuucaaggggcaguggaagaaccuggacaacgaccuggagcgcaaggcgcggcuccgcucccugauccugaagcacuucagcuuccucgagggcgccgccuacgggaagaagcuguucgagucccagagcuccggcaacaagagcuccaagaagaaggagcugaccaagaaggagaaggaggagcuccaggccaacgcgcugagccuggacaaccucaaguccauccuguucgacuuccugcagaagcucaaggacuuccggaacuacuacagccacuaccgccacccggaguccagcgagcugccccuguucgacgggaacaugcuccagcggcuguacaacguguucgacgucuccgugcagcgcgugaagcgggaccacgagcacaacgacaaggucgacccccaccgccacuucaaccaccuggugcggaagggcaagaaggacaaguacggcaacaacgacaaccccuucuucaagcaccacuucguggaccgcgaggagaaggucacggaggccgggcuccuguucuucgugagccuguuccucgagaagcgggacgccaucuggaugcagaagaagauccgcggcuucaagggcgggaccgaggccuaccagcagaugaccaacgagguguucugccggucccgcaucagccugccgaagcugaagcucgagucccugcggaccgacgacuggaugcugcucgacaugcugaacgagcugguccgcugccccaagcuccuguacgaccggcugcgcgaggaggaccgggcccgcuuccgcgugcccguggacauccucagcgacgaggacgacacggacgggaccgaggaggaccccuucaagaacacccugguccggcaccaggaccgcuucccguacuucgcgcugcgguacuucgaccucaagaagguguucaccucccugcgcuuccacaucgaccugggcacguaccacuucgccaucuacaagaagaacaucggcgagcagcccgaggaccggcaccucacccgcaaccuguacggguucggccggauccaggacuucgccgaggagcaccgccccgaggaguggaagcggcuggugcgcgaccucgacuacuucgagaccggggacaagcccuacaucacccagacgaccccgcacuaccacaucgagaagggcaagaucggccugcgguucguccccgaggggcagcugcuguggcccagccccgaggugggcgccacccgcaccgggcggagcaaguacgcccaggacaagcgcuucacggcggaggccuuccucuccgugcacgagcugaugccgaugauguucuacuacuuccugcuccgggagaaguacagcgaggaggccuccgccgagaagguccagggccgcaucaagcgggugaucgaggacguguacgccgucuacgacgcguucgcccgcgacgagaucaacacccgggacgagcuggacgccugccuggccgacaaggggauccgccgcggccaccucccccggcagaugaucgccauccugagccaggagcacaaggacauggaggagaaggugcgcaagaagcugcaggagaugaucgcggacaccgaccaccggcucgacaugcuggaccgccagaccgaccggaagauccgcaucggccggaagaacgccgggcugcccaaguccggcgugaucgccgacuggcucguccgcgacaugaugcgguuccagcccguggccaaggacacgagcgggaagccgcugaacaacuccaaggcgaacagcaccgaguaccgcaugcugcagcgggcccucgcccuguucggcggggagaaggagcgccugacccccuacuuccggcagaugaaccucaccggcggcaacaacccccaccccuuccugcacgagacgcgcugggagucccacaccaacauccugagcuucuaccgguccuaccucaaggcccgcaaggccuuccugcagagcaucgggcgguccgaccgcgaggagaaccaccgguuccugcuccugaaggagccgaagaccgaccgccagacccuggucgcgggcuggaaguccgaguuccaccucccccgggggaucuucacggaggccgugcgcgacugccugaucgagaugggcuacgacgagguggggagcuacaaggaggucggcuucauggccaaggccgugccccuguacuucgagcgcgccugcaaggaccgggugcagcccuucuacgacuacccguucaacgucggcaacagccucaagcccaagaaggggcgcuuccuguccaaggagaagcgggcggaggagugggagagcggcaaggagcgcuuccgggaccuggaggccuggucccacagcgccgcccgccggaucgaggacgccuucguggggaucgaguacgcgagcugggagaacaagaagaagaucgagcagcuccugcaggaccugucccucugggagaccuucgagagcaagcugaaggugaaggccgacaagaucaacaucgccaagcugaagaaggagauccucgaggccaaggagcaccccuaccacgacuucaaguccuggcagaaguucgagcgcgagcugcggcuggucaagaaccaggacaucaucaccuggaugaugugccgcgaccucauggaggagaacaagguggagggccuggacaccggcacgcuguaccucaaggacauccggaccgacgugcaggagcaggggagccugaacguccugaaccacgugaagccgaugcgccuccccguggucguguaccgggcggacucccgcggccacgugcacaaggaggaggcgccccuggccaccgucuacaucgaggagcgggacaccaagcugcucaagcaggggaacuucaagagcuucgugaaggaccgccggcugaacggccuguucuccuucguggacaccggggcccucgccauggagcaguaccccaucagcaagcugcgcgucgaguacgagcuggccaaguaccagacggcccgggugugcgccuucgagcagacccucgagcuggaggagucccugcucacccgcuacccgcaccuccccgacgagagcuuccgcgagaugcuggaguccuggagcgacccccugcuggacaaguggcccgaccugcagcgggaggugcgccuccugaucgccguccggaacgccuucucccacaaccaguacccgauguacgacgagaccaucuucagcuccauccgcaaguacgaccccagcucccuggacgcgaucgaggagcggaugggccucaacaucgcccaccgccugagcgaggaggugaagcuggccaaggagaugguggagcggaucauccaggccuga

SEQ ID NO: 11199 - RNA, 3360 nt, Artificial Sequence
  Cas13b variant__Porphyromonas gingivalis__WP_053444417.1__Cas13b
augaccgagcagaacgagaagcccuacaacggcaccuacuacacgcuggaggacaagcacuucugggccgccuuccucaaccuggcgcgccacaacgccuacaucacccuggcccacaucgaccggcagcucgccuacagcaaggccgacaucaccaacgacgaggacauccuguucuucaaggggcaguggaagaaccuggacaacgaccucgagcgcaaggcgcggcugcgcucccugauccucaagcacuucagcuuccuggagggcgccgccuacgggaagaagcuguucgagucccagagcuccggcaacaagagcuccaagaagaaggagcucagcaagaaggagaaggaggagcugcaggccaacgcgcugucccucgacaaccucaagagcauccuguucgacuuccuccagaagcugaaggacuuccggaacuacuacucccacuaccgccacccggagagcuccgagcugccccucuucgacgggaacaugcugcagcggcuguacaacguguucgacgucagcgugcagcgcgugaagcgggaccacgagcacaacgacaaggucgacccccaccgccacuucaaccaccucgugcggaagggcaagaaggacaaguacggcaacaacgacaaccccuucuucaagcaccacuucguggaccgcgaggggaccgucacggaggccggccugcuguucuucgugucccucuuccuggagaagcgggacgccaucuggaugcagaagaagauccgcggguucaagggcgggaccgaggccuaccagcagaugaccaacgagguguucugccggagccgcaucucccugccgaagcucaagcuggagagccugcggaccgacgacuggaugcuccuggacaugcugaacgagcucguccgcugccccaagucccuguacgaccggcugcgcgaggaggaccgggcccgcuuccgcgugcccguggacauccucagcgacgaggacgacacggacggcaccgaggaggaccccuucaagaacacccugguccggcaccaggaccgcuucccguacuucgcgcugcgguacuucgaccucaagaagguguucaccagccugcgcuuccacaucgaccugggcacguaccacuucgccaucuacaagaagaacaucggggagcagcccgaggaccggcaccucacccgcaaccuguacggcuucgggcggauccaggacuucgccgaggagcaccgccccgaggaguggaagcggcuggugcgcgaccucgacuacuucgagaccggcgacaagcccuacaucacccagacgaccccgcacuaccacaucgagaagggcaagaucgggcugcgguucguccccgagggccagcaccuguggcccucccccgaggugggggccacccgcaccggccggagcaaguacgcccaggacaagcgccugacggcggaggccuuccucuccgugcacgagcugaugccgaugauguucuacuacuuccugcuccgggagaaguacagcgaggaggucuccgccgagaaggugcaggggcgcaucaagcgggugaucgaggacgucuacgccguguacgacgccuucgcgcgcgacgagaucaacacccgggacgagcuggacgccugccuggccgacaagggcauccgccgcggccaccucccccggcagaugaucgccauccugagccaggagcacaaggacauggaggagaaggugcgcaagaagcugcaggagaugaucgccgacaccgaccaccggcucgacaugcuggaccgccagaccgaccggaagauccgcaucgggcggaagaacgcgggccugcccaaguccggggucguggccgacuggcucguccgcgacaugaugcgguuccagcccguggccaaggacacgagcggcaagccgcugaacaacuccaaggccaacagcaccgaguaccgcaugcugcagcgggcgcucgcccuguucgggggcgagaaggagcgccugacccccuacuuccggcagaugaaccucaccggcgggaacaacccccaccccuuccugcacgagacgcgcugggagucccacaccaacauccugagcuucuaccgguccuaccucgaggcccgcaaggccuuccugcagagcaucggccgguccgaccgcguggagaaccaccgguuccugcuccugaaggagccgaagaccgaccgccagacccuggucgccggguggaagggcgaguuccaccucccccgggggaucuucacggaggcggugcgcgacugccugaucgagaugggcuacgacgaggugggcagcuacaaggaggucggguucauggccaaggccgugccccuguacuucgagcgcgccuccaaggaccgggugcagcccuucuacgacuacccguucaacgucggcaacagccucaagcccaagaaggggcgcuuccuguccaaggagaagcgggccgaggagugggagagcggcaaggagcgcuuccggcuggcgaagcucaagaaggagauccuggaggccaaggagcaccccuaccacgacuucaagagcuggcagaaguucgagcgcgagcugcggcucgugaagaaccaggacaucaucaccuggaugaugugccgcgaccugauggaggagaacaagguggagggccuggacaccgggacccucuaccugaaggacauccggacggacguccaggagcagggcucccugaacgugcucaaccgcgugaagccgaugcggcugcccgucgugguguaccgcgccgacagccgggggcacguccacaaggagcaggcgccccuggccaccguguacaucgaggagcgcgacaccaagcuccugaagcagggcaacuucaaguccuucgugaaggaccggcgccugaacgggcuguucagcuucgucgacaccggcgcccuggccauggagcaguaccccaucuccaagcugcggguggaguacgagcucgccaaguaccagaccgcccgcgugugcgcguucgagcagacgcuggagcuggaggagagccuccugacccgguacccgcaccuccccgacaagaacuuccgcaagaugcuggaguccuggagcgacccccugcuggacaaguggcccgaccuccacggcaacguccgccugcugaucgccgugcggaacgccuucucccacaaccaguacccgauguacgacgagacccucuucagcuccauccgcaaguacgaccccagcucccccgacgccaucgaggagcggauggggcugaacaucgcccaccgccugagcgaggaggugaagcaggcgaaggagauggucgagcggaucauccaggccuga

SEQ ID NO: 11200 - RNA, 3360 nt, Artificial Sequence
  Cas13b variant__Porphyromonas gingivalis__WP_012458414.1__Cas13b
augaccgagcagaacgagcgccccuacaacggcaccuacuacacgcuggaggacaagcacuucugggccgccuucuucaaccucgcgcggcacaacgccuacaucacccuggcccacaucgaccgccagcuggccuacagcaaggccgacaucaccaacgacgaggacauccucuucuucaaggggcaguggaagaaccuggacaacgaccuggagcggaaggcgcgccuccggucccugauccugaagcacuucagcuuccucgagggcgccgccuacgggaagaagcuguucgagucccagagcuccggcaacaagagcuccaagaagaaggagcugaccaagaaggagaaggaggagcuccaggccaacgcgcugagccuggacaaccucaaguccauccuguucgacuuccugcagaagcucaaggacuuccgcaacuacuacagccacuaccggcacccggaguccagcgagcugccccuguucgacgggaacaugcuccagcgccuguacaacguguucgacgucuccgugcagcgggugaagcgcgaccacgagcacaacgacaaggucgacccccaccggcacuucaaccaccuggugcgcaagggcaagaaggaccgguacggcaacaacgacaaccccuucuucaagcaccacuucguggaccgcgaggagaaggucacggaggccgggcuccuguucuucgugagccuguuccucgagaagcgggacgccaucuggaugcagaagaagauccgcggcuucaagggcgggaccgagaccuaccagcagaugaccaacgagguguucugccggucccgcaucagccugccgaagcugaagcucgagucccugcggacggacgacuggaugcugcucgacaugcugaacgagcugguccgcugccccaagagccucuacgaccggcugcgcgaggaggaccgcgcccgguuccgcgugcccguggacauccuguccgacgaggacgacaccgacgggaccgaggaggaccccuucaagaacacccucguccggcaccaggaccgcuucccguacuucgcccugcgguacuucgaccugaagaagguguucacgagccuccgcuuccacaucgaccugggcaccuaccacuucgcgaucuacaagaagaacaucggcgagcagcccgaggaccggcaccugacccgcaaccucuacggguucggccggauccaggacuucgccgaggagcaccgccccgaggaguggaagcggcuggugcgcgaccuggacuacuucgagaccggggacaagcccuacaucacgcagaccaccccgcacuaccacaucgagaagggcaagaucggccuccgguucguccccgaggggcagcaccuguggcccagccccgaggugggcgccacccgcacggggcgguccaaguacgcccaggacaagcgccugaccgccgaggcguuccugagcgugcacgagcucaugccgaugauguucuacuacuuccugcugcgggagaaguacuccgacgaggccagcgccgagcgcguccagggccggaucaagcgcgugaucgaggacguguacgccgucuacgacgccuucgcgcgcggggagaucaacacccgggacgagcucgacgccugccuggccgacaagggcauccgccggggccaccucccccgccagaugaucgggauccugucccaggagcacaaggacauggaggagaaggugcggaagaagcugcaggagaugaucguggacaccgaccaccgccuggacaugcucgaccggcagacggaccgcaagauccggaucggccgcaagaacgccgggcugcccaagagcggcgucaucgccgacuggcuggugcgggacaugaugcgcuuccagcccgucgcgaaggacaccuccgggaagccgcucaacaacagcaaggccaacuccaccgaguaccggaugcugcagcgcgcccuggcccucuucggcggcgagaaggagcggcugacccccuacuuccgccagaugaaccugaccgggggcaacaacccccaccccuuccuccacgagacgcggugggagagccacaccaacauccuguccuucuaccgcagcuaccugaaggcgcggaaggccuuccuccaguccaucgggcgcagcgaccggguggagaaccaccgcuuccugcugcucaaggagccgaagaccgaccgccagacgcugguggccggcuggaagggggaguuccaccucccccggggcaucuucaccgaggccguccgcgacugccugaucgagaugggccuggacgaggugggguccuacaaggaggugggcuucauggccaaggcggucccccuguacuucgagcgggccugcaaggaccgcgugcagcccuucuacgacuacccguucaacguggggaacagccucaagcccaagaagggccgguuccuguccaaggagaagcgcgccgaggagugggagagcggcaaggagcgguuccgccuggccaagcucaagaaggagauccuggaggccaaggagcaccccuaccuggacuucaaguccuggcagaaguucgagcgggagcuccgccuggucaagaaccaggacaucaucaccuggaugaucugccgggaccugauggaggagaacaagguggaggggcucgacaccggcacgcuguaccugaaggacauccgcaccgacgugcaggagcaggggaaccucaacguccugaaccgggugaagccgaugcgccugcccguggucguguaccgggcggacagccgcggccacgugcacaaggagcaggcgccccucgccaccgucuacaucgaggagcgggacaccaagcugcugaagcaggggaacuucaagagcuucgugaaggaccgccggcucaacggccuguucuccuucguggacaccggcgcccuggccauggagcaguaccccaucagcaagcuccgcgucgaguacgagcuggccaaguaccagacggcccgcgugugcgccuucgagcagacccuggagcucgaggagucccugcugacccgguacccgcaccuccccgacaagaacuuccgcaagaugcuggagagcugguccgacccccugcucgacaaguggcccgaccugcacgggaacgugcggcugcucaucgccguccgcaacgcguucagccacaaccaguacccgauguacgacgaggccguguucuccagcauccggaaguacgaccccuccagccccgacgccaucgaggagcgcaugggccugaacaucgcccaccggcuguccgaggaggugaagcaggccaaggagauggcggagcgcaucauccaggccuga

SEQ ID NO: 11201 - RNA, 3360 nt, Artificial Sequence
  Cas13b variant__Porphyromonas gingivalis__WP_039417390.1__Cas13b
augaccgagcagaacgagcgccccuacaacggcaccuacuacacgcuggaggacaagcacuucugggccgccuucuucaaccucgcgcggcacaacgccuacaucacccuggcccacaucgaccgccagcuggccuacagcaaggccgacaucaccaacgacgaggacauccucuucuucaaggggcaguggaagaaccuggacaacgaccuggagcggaaggcgcgccuccggucccugauccugaagcacuucagcuuccucgagggcgccgccuacgggaagaagcuguucgagucccagagcuccggcaacaagagcuccaagaagaaggagcugaccaagaaggagaaggaggagcuccaggccaacgcgcugagccuggacaaccucaaguccauccuguucgacuuccugcagaagcucaaggacuuccgcaacuacuacagccacuaccggcacccggaguccagcgagcugccccuguucgacgggaacaugcuccagcgccuguacaacguguucgacgucuccgugcagcgggugaagcgcgaccacgagcacaacgacaaggucgacccccaccggcacuucaaccaccuggugcgcaagggcaagaaggaccgguacggcaacaacgacaaccccuucuucaagcaccacuucguggaccgcgaggggacggucaccgaggccggccuccuguucuucgugagccuguuccucgagaagcgggacgccaucuggaugcagaagaagauccgcggguucaagggcgggaccgaggccuaccagcagaugaccaacgagguguucugccggucccgcaucagccugccgaagcugaagcucgagucccugcggacggacgacuggaugcugcucgacaugcugaacgagcugguccgcugccccaagagccucuacgaccggcugcgcgaggaggaccgcgcccgguuccgcgugcccaucgacauccuguccgacgaggacgacaccgacggcaccgaggaggaccccuucaagaacacccucgugcggcaccaggaccgcuucccguacuucgcgcugcgguacuucgaccugaagaaggucuucacgagccuccgcuuccacaucgaccugggcaccuaccacuucgccaucuacaagaagaacaucggggagcagcccgaggaccggcaccugacccgcaaccucuacggcuucgggcggauccaggacuucgccgaggagcaccgccccgaggaguggaagcggcuggugcgcgaccuggacuacuucgagaccggcgacaagcccuacaucacgcagaccaccccgcacuaccacaucgagaagggcaagaucgggcuccgguucgugcccgagggccagcaccuguggcccagccccgaggucggggccacccgcacgggccgguccaaguacgcccaggacaagcgccugaccgcggaggccuuccugagcgugcacgagcucaugccgaugauguucuacuacuuccugcugcgggagaaguacuccgaggaggugagcgccgagaagguccaggggcgcaucaagcgggugaucgaggacguguacgccgucuacgacgccuucgcgcgcggcgagaucgacacccucgaccgccuggacgccugccuggccgacaagggcauccggcgcgggcaccucccccggcagaugaucgccauccugucccaggagcacaaggacauggaggagaaggugcgcaagaagcugcaggagaugaucgccgacaccgaccaccggcucgacaugcuggaccgccagacggaccggaagauccgcaucggccggaagaacgcggggcugcccaagagcggcgugaucgccgacuggcucguccgcgacaugaugcgguuccagcccguggccaaggacaccuccgggaagccgcugaacaacagcaaggccaacuccaccgaguaccgcaugcugcagcgggcgcucgcccuguucggcggcgagaaggagcgccugacccccuacuuccggcagaugaaccucaccgggggcaacaacccccaccccuuccugcacgagacgcgcugggagagccacaccaacauccuguccuucuaccggagcuaccucaaggcccgcaaggccuuccugcaguccaucgggcggagcgaccgcgaggagaaccaccgguuccugcuccugaaggagccgaagaccgaccgccagacgcuggucgccggcuggaaguccgaguuccaccucccccgcgggaucuucaccgaggcggugcgggacugccugaucgagaugggcuacgacgaggugggcagcuacaaggaggucggguucauggccaaggccgugccccuguacuucgagcgcgccugcaaggaccgggugcagcccuucuacgacuacccguucaacgucggcaacucccucaagcccaagaaggggcgcuuccugagcaaggagaagcgggccgaggagugggaguccggcaaggagcgcuuccggcuggcgaagcucaagaaggagauccuggaggccaaggagcaccccuaccuggacuucaagagcuggcagaaguucgagcgcgagcuccggcuggugaagaaccaggacaucaucaccuggaugaugugccgcgaccugauggaggagaacaagguggagggccucgacaccgggacgcuguaccugaaggacauccggaccgacguccacgagcagggcagccucaacgugcugaaccgcgugaagccgaugcggcugcccgucgugguguaccgcgccgacucccgggggcacguccacaaggagcaggcgccccucgccaccguguacaucgaggagcgcgacaccaagcugcugaagcagggcaacuucaagagcuucgugaaggaccggcgccucaacgggcuguucuccuucgucgacaccggcgcccuggccauggagcaguaccccaucagcaagcuccggguggaguacgagcuggccaaguaccagacggcccgcgugugcgcguucgagcagacccuggagcucgaggagucccugcugacccgcuacccgcaccuccccgacaagaacuuccggaagaugcuggagagcugguccgacccccugcucgacaaguggcccgaccugcaccgcaagguccggcugcucaucgccgugcgcaacgccuucagccacaaccaguacccgauguacgacgaggccguguucuccagcauccggaaguacgaccccuccagccccgacgccaucgaggagcgcaugggccugaacaucgcgcaccggcuguccgaggaggucaagcaggccaaggagauggccgagcgcaucauccagguguga

SEQ ID NO: 11202 - RNA, 3528 nt, Artificial Sequence
  Cas13b variant__Porphyromonas gingivalis__EOA10535.1__Cas13b
augaccgagcagaacgagaagcccuacaacggcaccuacuacacgcuggaggacaagcacuucugggccgccuucuucaaccucgcgcgccacaacgccuacaucacccugacccacaucgaccggcagcuggccuacagcaaggccgacaucaccaacgacgaggacauccucuucuucaaggggcaguggaagaaccuggacaacgaccuggagcgcaaggcccggcuccgcucccugauccugaagcacuucagcuuccucgagggcgcggccuacgggaagaagcuguucgagucccagagcuccggcaacaagagcuccaagaagaaggagcugacgaagaaggagaaggaggagcuccaggccaacgcccugagccuggacaaccucaaguccauccuguucgacuuccugcagaagcucaaggacuuccggaacuacuacagccacuaccgccacccggaguccagcgagcugccccuguucgacgggaacaugcuccagcggcuguacaacguguucgacgucuccgugcagcgcgugaagcgggaccacgagcacaacgacaaggucgacccccaccgccacuucaaccaccuggugcggaagggcaagaaggaccgcugcggcaacaacgacaaccccuucuucaagcaccacuucguggaccgggaggagaaggucaccgaggcggggcuccuguucuucgugagccuguuccucgagaagcgcgacgccaucuggaugcagaagaagauccggggcuucaagggcgggaccgagaccuaccagcagaugacgaacgagguguucugccgcucccggaucagccugccgaagcugaagcucgagucccugcgcaccgacgacuggaugcugcucgacaugcugaacgagcugguccggugccccaagagccucuacgaccgccugcgggaggaggaccgcgcccgcuuccgggugcccguggacauccuguccgacgaggacgacaccgacgggaccgaggaggaccccuucaagaacacgcucguccgccaccaggaccgguucccguacuucgcccugcgcuacuucgaccugaagaagguguucaccagccuccgguuccacaucgaccugggcaccuaccacuucgccaucuacaagaagaacaucggcgagcagcccgaggaccgccaccugacccggaaccucuacggguucggccgcauccaggacuucgcggaggagcaccggcccgaggaguggaagcgccuggugcgggaccuggacuacuucgagacgggggacaagcccuacaucacccagaccaccccgcacuaccacaucgagaagggcaagaucggccuccgcuucguccccgaggggcagcugcuguggcccagccccgaggugggcgccacgcggaccgggcgcuccaaguacgcccaggacaagcgguucaccgccgaggccuuccugagcgugcacgagcucaugccgaugauguucuacuacuuccugcugcgcgagaaguacuccgaggaggcgagcgccgagcggguccagggccgcaucaagcgggugaucgaggacguguacgccgucuacgacgccuucgcccgcggggagaucgacacccucgaccgccuggacgcgugccuggccgacaagggcauccggcgcggccaccucccccggcagaugaucgccauccugucccaggagcacaaggacauggaggagaaggugcgcaagaagcugcaggagaugaucgccgacacggaccaccggcucgacaugcuggaccgccagaccgaccggaagauccgcaucgggcggaagaacgccggccugcccaagagcggggugaucgcggacuggcucguccgcgacaugaugcgguuccagcccguggccaaggacaccuccggcaagccgcugaacaacagcaaggccaacuccaccgaguaccgcaugcugcagcgggcccucgcgcuguucgggggcgagaaggagcgccugacgcccuacuuccggcagaugaaccucaccggcgggaacaacccccaccccuuccugcacgagacccgcugggagagccacaccaacauccuguccuucuaccggagcuaccucaaggcccgcaaggccuuccugcaguccaucggccggagcgaccgcgucgagaaccaccgguuccugcuccugaaggagccgaagacggaccgccagacccugguggccggguggaagggcgaguuccaccucccccgcgggaucuucaccgaggccgugcgggacugccugaucgagaugggccuggacgaggucggcuccuacaaggaggugggguucauggcgaaggccgugccccucuacuucgagcgcgccugcaaggaccggguccagcccuucuacgacuacccguucaacgugggcaacagccugaagcccaagaaggggcgcuuccuguccaaggagaagcgggccgaggagugggagagcggcaaggagcgcuuccgggaccucgaggccuggucccacagcgcggcccgccggaucgaggacgccuucgccggcaucgagaacgccagccgcgagaacaagaagaagaucgagcagcugcugcaggaccucucccugugggagaccuucgagagcaagcugaaggugaaggcggacaagaucaacaucgccaagcucaagaaggagauccuggaggccaaggagcaccccuaccuggacuucaaguccuggcagaaguucgagcgggagcuccgccuggucaagaaccaggacaucaucacguggaugaugugccgggaccugauggaggagaacaagguggaggggcucgacaccggcacccuguaccugaaggacauccgcaccgacgugcacgagcaggggagccucaacguccugaaccgggugaagccgaugcgccugcccguggucguguaccgggccgacucccgcggccacgugcacaaggagcaggcgccccucgccaccgucuacaucgaggagcgggacacgaagcugcugaagcaggggaacuucaagagcuucgugaaggaccgccgccucaacggccuguucuccuucguggacaccggcgcccuggccauggagcaguaccccaucagcaagcuccgggucgaguacgagcuggccaaguaccagaccgcgcgcgugugcgccuucgagcagacccuggagcucgaggagucccugcugacgcgguacccgcaccuccccgacaagaacuuccgcaagaugcuggagagcugguccgacccccugcucgacaaguggcccgaccugcacgggaacgugcggcugcucaucgccguccgcaacgccuucagccacaaccaguacccgauguacgacgagacccuguucuccagcauccggaaguacgaccccuccagccccgacgccaucgaggagcgcaugggccugaacaucgcgcaccggcucuccgaggaggugaagcaggccaaggagaugguggagcgcaucauccaggccuga

SEQ ID NO: 11203 - RNA, 3360 nt, Artificial Sequence
  Cas13b variant__Porphyromonas gingivalis__WP_061156470.1__Cas13b
augaccgagcagaacgagcgccccuacaacggcaccuacuacacgcuggaggacaagcacuucugggccgccuucuucaaccucgcgcggcacaacgccuacaucacccugacccacaucgaccgccagcuggccuacagcaaggccgacaucaccaacgacgaggacauccucuucuucaaggggcaguggaagaaccuggacaacgaccuggagcggaaggcccgccuccggucccugauccugaagcacuucagcuuccucgagggcgcggccuacgggaagaagcuguucgagaacaaguccagcggcaacaaguccagcaagaagaaggagcugacgaagaaggagaaggaggagcuccaggccaacgcccugucccuggacaaccucaagagcauccuguucgacuuccugcagaagcucaaggacuuccgcaacuacuacucccacuaccggcacccggagagcuccgagcugccccuguucgacgggaacaugcuccagcgccuguacaacguguucgacgucagcgugcagcgggugaagcgcgaccacgagcacaacgacaaggucgacccccaccggcacuucaaccaccuggugcgcaagggcaagaaggaccggugcggcaacaacgacaaccccuucuucaagcaccacuucguggaccgcgaggggaaggucaccgaggcgggccuccuguucuucgugucccuguuccucgagaagcgggacgccaucuggaugcagaagaagauccgcggguucaagggcgggaccgaggccuaccagcagaugaccaacgagguguucugccggagccgcaucucccugccgaagcugaagcucgagagccugcggacggacgacuggaugcugcucgacaugcugaacgagcugguccgcugccccaagucccucuacgaccggcugcgcgaggaggaccgcgcccgguuccgcgugcccguggacauccugagcgacgaggacgacaccgacggcaccgaggaggaccccuucaagaacacccucguccggcaccaggaccgcuucccguacuucgcccugcgguacuucgaccugaagaagguguucacgucccuccgcuuccacaucgaccugggcaccuaccacuucgcgaucuacaagaagaacaucggggagcagcccgaggaccggcaccugacccgcaaccucuacggcuucgggcggauccaggacuucgccgaggagcaccgccccgaggaguggaagcggcuggugcgcgaccuggacuacuucgagaccggcgacaagcccuacaucacgcagaccaccccgcacuaccacaucgagaagggcaagaucgggcuccgguucguccccgagggccagcaccuguggcccagccccgaggugggggccacccgcacgggccggagcaaguacgcccaggacaagcgccugaccgccgaggcguuccuguccgugcacgagcucaugccgaugauguucuacuacuuccugcugcgggagaaguacagcgaggaggucuccgccgagaaggugcaggggcgcaucaagcgggugaucgaggacgucuacgccguguacgacgccuucgcccgcggcgagaucgacacccucgaccgccuggacgcgugccuggccgacaagggcauccggcgcgggcaccucccccggcagaugaucgccauccugagccaggagcacaaggacauggaggagaaggugcgcaagaagcugcaggagaugaucgccgacaccgaccaccggcucgacaugcuggaccgccagacggaccggaagauccgcaucggccggaagaacgccgggcugcccaaguccggcgucaucgcggacuggcucgugcgcgacaugaugcgguuccagcccgucgccaaggacaccagcgggaagccgcugaacaacuccaaggccaacagcaccgaguaccgcaugcugcagcgggcccucgcgcuguucggcggcgagaaggagcgccugacccccuacuuccggcagaugaaccucaccgggggcaacaacccccaccccuuccugcacgagacgcgcugggagucccacaccaacauccugagcuucuaccgguccuaccucaaggcccgcaaggccuuccugcagagcaucgggcgguccgaccgcgaggagaaccaccgguuccugcuccugaaggagccgaagaccgaccgccagacgcugguggccggcuggaaguccgaguuccaccucccccgcgggaucuucaccgaggccgugcgggacugccugaucgagaugggcuacgacgaggucggcagcuacaaggaggugggguucauggcgaaggccgugccccuguacuucgagcgcgccugcaaggaccggguccagcccuucuacgacuacccguucaacgugggcaacagccucaagcccaagaaggggcgcuuccuguccaaggagaagcgggccgaggagugggagagcggcaaggagcgcuuccggcuggccaagcucaagaaggagauccuggaggcgaaggagcaccccuaccuggacuucaaguccuggcagaaguucgagcgcgagcuccggcuggugaagaaccaggacaucaucaccuggaugaugugccgcgaccugauggaggagaacaaggucgagggccucgacaccgggacgcuguaccugaaggacauccggaccgaggugcaggagcagggcagccucaacgugcugaaccgcgucaagccgaugcggcugcccgugguggucuaccgcgccgacagccgggggcacgugcacaaggagcaggcgccccucgccaccguguacaucgaggagcgcgacaccaagcugcugaagcagggcaacuucaaguccuucgucaaggaccggcgccucaacgggcuguucagcuucguggacaccggcggccuggccauggagcaguaccccaucuccaagcuccggguggaguacgagcuggccaaguaccagacggcccgcgucugcgccuucgagcagacccuggagcucgaggagagccugcugacccgcugcccgcaccuccccgacaagaacuuccggaagaugcuggaguccuggagcgacccccugcucgacaaguggcccgaccugcagcgcgagguguggcugcucaucgccgugcggaacgcguucucccacaaccaguacccgauguacgacgaggccgucuucagcuccauccgcaaguacgaccccagcucccccgacgccaucgaggagcggauggggcugaacaucgcccaccgccugagcgaggaggugaagcaggccaaggagauggcggagcggaucauccaggccuga

SEQ ID NO: 11204 - RNA, 3360 nt, Artificial Sequence
  Cas13b variant__Porphyromonas gingivalis__WP_013816155.1__Cas13b
augaccgagcagaacgagaagcccuacaacggcaccuacuacacgcuggaggacaagcacuucugggccgccuucuucaaccucgcgcgccacaacgccuacaucacccuggcccacaucgaccggcagcuggccuacagcaaggccgacaucaccaacgacgaggacauccucuucuucaaggggcaguggaagaaccuggacaacgaccuggagcgcaaggcgcggcuccgcucccugauccugaagcacuucagcuuccucgagggcgccgccuacgggaagaagcuguucgagucccagagcuccggcaacaagagcuccaagaacaaggagcugaccaagaaggagaaggaggagcuccaggccaacgcgcugagccuggacaaccucaaguccauccuguucgacuuccugcagaagcucaaggacuuccggaacuacuacagccacuaccgccacccggaguccagcgagcugccccuguucgacgggaacaugcuccagcggcuguacaacguguucgacgucuccgugcagcgcgugaagcgggaccacgagcacaacgacaaggucgacccccaccgccacuucaaccaccuggugcggaagggcaagaaggaccgcuacggcaacaacgacaaccccuucuucaagcaccacuucguggaccgggaggggacggucaccgaggccggccuccuguucuucgugagccuguuccucgagaagcgcgacgccaucuggaugcagaagaagauccggggguucaagggcgggaccgagaccuaccagcagaugacgaacgagguguucugccgcucccggaucagccugccgaagcugaagcucgagucccugcgcaccgacgacuggaugcugcucgacaugcugaacgagcugguccggugccccaagagccucuacgaccgccugcgggaggaggaccgcgcccgcuuccgggugcccguggacauccuguccgacgaggaggacaccgacggcgccgaggaggaccccuucaagaacacccucguccgccaccaggaccgguucccguacuucgcgcugcgcuacuucgaccugaagaagguguucacgagccuccgguuccagaucgaccugggcaccuaccacuucgccaucuacaagaagaacaucggggagcagcccgaggaccgccaccugacccggaaccucuacggcuucgggcgcauccaggacuucgccgaggagcaccggcccgaggaguggaagcgccuggugcgggaccuggacuacuucgagaccggcgacaagcccuacaucacgcagaccaccccgcacuaccacaucgagaagggcaagaucgggcuccgcuucguccccgagggccagcaccuguggcccagccccgaggugggggccacccggacgggccgcuccaaguacgcccaggacaagcgguucaccgcggaggccuuccugagcgcccacgagcugaugccgaugauguucuacuacuuccuccugcgcgagaaguacuccgaggaggccagcgccgagcgggugcaggggcgcaucaagcgggucaucgaggacguguacgcgguguacgacgccuucgcccgcgacgagaucaacacccgcgacgagcuggacgccugccucgccgacaagggcauccggcgcggccaccucccccggcagaugaucgggauccugucccaggagcacaaggacauggaggagaagauccgcaagaagcugcaggagaugauggcggacaccgaccaccggcuggacaugcuggaccgccagacggaccggaagauccgcaucggccggaagaacgccgggcuccccaagagcggcgucaucgccgacuggcuggugcgcgacaugaugcgguuccagcccguggccaaggacaccuccgggaagccgcugaacaacagcaaggcgaacuccaccgaguaccgcaugcuccagcgggcccuggcccuguucggcggcgagaaggagcgccucacccccuacuuccggcagaugaaccugaccgggggcaacaacccccaccccuuccugcacgagacgcgcugggagagccacaccaacauccucuccuucuaccggagcuaccugaaggcccgcaaggccuuccugcaguccaucgggcggagcgaccgcgucgagaaccaccgguuccuccugcugaaggagccgaagaccgaccgccagacgcucguggcgggcuggaagggggaguuccaccucccccgcggcaucuucaccgaggccguccgggacugccugaucgagaugggccuggacgaggugggguccuacaaggaggugggcuucauggccaaggccgucccccuguacuucgagcgcgccugcaaggacugggugcagcccuucuacaacuacccguucaacguggggaacagccugaagcccaagaagggccgguuccucuccaaggagaagcgcgcggaggagugggagagcggcaaggagcgguuccgccuggccaagcugaagaaggagauccucgaggccaaggagcaccccuaccuggacuucaaguccuggcagaaguucgagcgggagcugcgccucgucaagaaccaggacaucaucaccuggaugaucugcggggaccugauggaggagaacaagguggagggccuggacaccgggacgcucuaccugaaggacauccggaccgacgugcaggagcagggcagccugaacguccucaaccgcgugaagccgaugcggcugcccguggucguguaccgcgccgacagccgggggcacgugcacaaggagcaggcgccccuggccaccgucuacaucgaggagcgcgacaccaagcuccugaagcagggcaacuucaaguccuucgugaaggaccggcgccugaacggccucuucagcuucguggacaccggggcccuggccauggagcaguaccccaucuccaagcugcgggucgaguacgagcucgccaaguaccagacggcgcgcgugugcgccuucgagcagacccuggagcuggaggagagccuccugacccggugcccgcaccuccccgacaagaacuuccgcaagaugcuggaguccuggagcgacccccugcuggacaaguggcccgaccuccaccgcaaggugcggcugcugaucgccguccgcaacgccuucucccacaaccaguacccgauguacgacgaggccguguucagcuccauccggaaguacgaccccagcuuccccgacgcgaucgaggagcgcaugggccucaacaucgcccaccggcuguccgaggaggugaagcaggccaaggagaccgucgagcgcaucauccaggccuga

SEQ ID NO: 11205 - RNA, 3528 nt, Artificial Sequence
  Cas13b variant__Porphyromonas gingivalis__WP_005874195.1__Cas13b
augaccgagcagaacgagaagcccuacaacggcaccuacuacacgcuggaggacaagcacuucugggccgccuucuucaaccucgcgcgccacaacgccuacaucacccuggcccacaucgaccggcagcuggccuacagcaaggccgacaucaccaacgacgaggacauccucuucuucaaggggcaguggaagaaccuggacaacgaccuggagcgcaaggcgcggcuccgcucccugauccugaagcacuucagcuuccucgagggcgccgccuacgggaagaagcuguucgagucccagagcuccggcaacaagagcuccaagaagaaggagcugaccaagaaggagaaggaggagcuccaggccaacgcgcugagccuggacaaccucaaguccauccuguucgacuuccugcagaagcucaaggacuuccggaacuacuacagccacuaccgccacccggaguccagcgagcugccccuguucgacgggaacaugcuccagcggcuguacaacguguucgacgucuccgugcagcgcgugaagcgggaccacgagcacaacgacaaggucgacccccaccgccacuucaaccaccuggugcggaagggcaagaaggacaaguacggcaacaacgacaaccccuucuucaagcaccacuucguggaccgcgaggagaaggucacggaggccgggcuccuguucuucgugagccuguuccucgagaagcgggacgccaucuggaugcagaagaagauccgcggcuucaagggcgggaccgaggccuaccagcagaugaccaacgagguguucugccggucccgcaucagccugccgaagcugaagcucgagucccugcggaccgacgacuggaugcugcucgacaugcugaacgagcugguccgcugccccaagagccucuacgaccggcugcgcgaggaggaccgggcccgcuuccgcgugcccguggacauccuguccgacgaggacgacacggacgggaccgaggaggaccccuucaagaacacccucguccggcaccaggaccgcuucccguacuucgcgcugcgguacuucgaccugaagaagguguucaccagccuccgcuuccacaucgaccugggcacguaccacuucgccaucuacaagaagaacaucggcgagcagcccgaggaccggcaccugacccgcaaccucuacggguucggccggauccaggacuucgccgaggagcaccgccccgaggaguggaagcggcuggugcgcgaccuggacuacuucgagaccggggacaagcccuacaucacccagacgaccccgcacuaccacaucgagaagggcaagaucggccuccgguucguccccgaggggcagcugcuguggcccagccccgaggugggcgccacccgcaccgggcgguccaaguacgcccaggacaagcgcuucacggcggaggccuuccugagcgugcacgagcucaugccgaugauguucuacuacuuccugcugcgggagaaguacuccgaggaggccagcgccgagaagguccagggccgcaucaagcgggugaucgaggacguguacgccgucuacgacgcguucgcccgcgacgagaucaacacccgggacgagcucgacgccugccuggccgacaaggggauccgccgcggccaccucccccggcagaugaucgccauccugucccaggagcacaaggacauggaggagaaggugcgcaagaagcugcaggagaugaucgcggacaccgaccaccggcuggacaugcucgaccgccagaccgaccggaagauccgcaucggccggaagaacgccgggcugcccaagagcggcgugaucgccgacuggcugguccgcgacaugaugcgguuccagcccguggccaaggacacguccgggaagccgcucaacaacagcaaggcgaacuccaccgaguaccgcaugcugcagcgggcccuggcccucuucggcggggagaaggagcgccugacccccuacuuccggcagaugaaccugaccggcggcaacaacccccaccccuuccuccacgagacgcgcugggagagccacaccaacauccuguccuucuaccggagcuaccugaaggcccgcaaggccuuccuccaguccaucgggcggagcgaccgcgaggagaaccaccgguuccugcugcucaaggagccgaagaccgaccgccagacccuggucgcgggcuggaaguccgaguuccaccucccccgggggaucuucacggaggccgugcgcgacugccugaucgagaugggcuacgacgagguggggagcuacaaggaggucggcuucauggccaaggccgugccccuguacuucgagcgcgccugcaaggaccgggugcagcccuucuacgacuacccguucaacgucggcaacucccugaagcccaagaaggggcgcuuccucagcaaggagaagcgggcggaggagugggaguccggcaaggagcgcuuccgggaccuggaggccuggagccacagcgccgcccgccggaucgaggacgccuucguggggaucgaguacgcguccugggagaacaagaagaagaucgagcagcugcuccaggaccugagccugugggagaccuucgaguccaagcucaaggugaaggccgacaagaucaacaucgccaagcugaagaaggagauccuggaggccaaggagcaccccuaccacgacuucaagagcuggcagaaguucgagcgcgagcuccggcuggucaagaaccaggacaucaucaccuggaugaugugccgcgaccugauggaggagaacaagguggagggccucgacaccggcacgcuguaccugaaggacauccggaccgacgugcaggagcaggggucccucaacguccugaaccacgugaagccgaugcgccugcccguggucguguaccgggcggacagccgcggccacgugcacaaggaggaggcgccccucgccaccgucuacaucgaggagcgggacaccaagcugcugaagcaggggaacuucaaguccuucgugaaggaccgccggcucaacggccuguucagcuucguggacaccggggcccuggccauggagcaguaccccaucuccaagcuccgcgucgaguacgagcuggccaaguaccagacggcccgggugugcgccuucgagcagacccuggagcucgaggagagccugcugacccgcuacccgcaccuccccgacgaguccuuccgcgagaugcuggagagcugguccgacccccugcucgacaaguggcccgaccugcagcgggaggugcgccugcucaucgccguccggaacgccuucagccacaaccaguacccgauguacgacgagaccaucuucuccagcauccgcaaguacgaccccuccagccuggacgcgaucgaggagcggaugggccugaacaucgcccaccgccucagcgaggaggugaagcuggccaaggagaugguggagcggaucauccaggccuga

SEQ ID NO: 11206 - RNA, 3360 nt, Artificial Sequence
  Cas13b variant__Porphyromonas gulae__WP_039437199.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgacgaggacauccuguucuucaaggggcaguggaagaaccuggacaacgaccucgagcgcaagagccggcugcggucccugauccucaagcacuucagcuuccuggagggcgccgcguacgggaagaaguucuucgaguccaagagcuccggcaacaagagcuccaagaacaaggagcugacgaagaaggagaaggaggagcuccaggccaacgcccugagccuggacaaccucaaguccauccuguucgacuuccugcagaagcucaaggacuuccgcaacuacuacagccacuaccggcacuccgggagcuccgagcugccgcuguucgacggcaacaugcuccagcgccuguacaacguguucgacgucagcgugcagcgggugaagcgcgaccacgagcacaacgacgaggucgacccccacuaccacuucaaccaccuggugcggaagggcaagaaggaccgcuacgggcacaacgacaaccccuccuucaagcaccacuucguggacggcgaggggauggucaccgaggccggccuccuguucuucgugagccuguuccucgagaagcgggacgcgaucuggaugcagaagaagauccgcggguucaagggcggcaccgagcccuacgagcagaugaccaacgagguguucugccggucccgcaucagccugccgaagcugaagcucgagagccugcggacggacgacuggaugcugcucgacaugcugaacgagcugguccgcugccccaagccccucuacgaccggcugcgcgagaaggaccgggccugcuuccgcgugcccguggacauccugccggacgaggacgacaccgacgggggcggggaggaccccuucaagaacacccucguccgccaccaggaccgguuccccuacuucgcccugcgcuacuucgaccugaagaagguguucaccucccuccgguuccacaucgaccugggcacguaccacuucgccaucuacaagaagaugaucggcgagcagcccgaggaccgccaccugacccggaaccucuacggguucggccgcauccaggacuucgccgaggagcaccggccggaggaguggaagcgccuggugcgggaccuggacuacuucgagaccggggacaagcccuacaucagccagaccacgccccacuaccacaucgagaagggcaagaucgggcuccgcuucguccccgagggccagcaccuguggccgucccccgaggugggcaccacccggaccgggcgcagcaaguacgcgcaggacaagcggcugacggccgaggccuuccuguccgugcacgagcucaugcccaugauguucuacuacuuccugcugcgcgagaaguacagcgaggaggucuccgccgagaaggugcagggccggaucaagcgcgugaucgaggacgucuacgccaucuacgacgcguucgcccgggacgagaucaacacccucaaggagcuggacgccugccuggccgacaaggggauccgccggggccaccuccccaagcagaugaucgggauccugagccaggagcgcaaggacauggaggagaaggugcgcaagaagcugcaggagaugaucgccgacaccgaccaccggcucgacaugcuggaccgccagaccgaccggaagauccgcaucggccggaagaacgcgggccugccgaaguccggggugaucgccgacuggcucguccgcgacaugaugcgguuccagcccguggccaaggacacgagcggcaagccccugaacaacuccaaggccaacagcaccgaguaccgcaugcugcagcgggcccucgcgcuguucgggggcgagaaggagcgccugacccccuacuuccggcagaugaaccucaccgggggcaacaacccgcaccccuuccugcacgagacgcgcugggagucccacaccaacauccugagcuucuaccgguccuaccuccgcgcccggaaggccuuccuggagcgcaucggccggagcgaccgcgucgagaacugccccuuccugcuccugaaggagcccaagaccgaccggcagacccugguggccggguggaagggcgaguuccaccucccgcgcgggaucuucacggaggcggugcgggacugccugaucgagaugggcuacgacgaggucggcuccuaccgcgaggugggguucauggccaaggccgugccccuguacuucgagcgcgccugcgaggaccggguccagcccuucuacgacagcccguucaacgugggcaacucccucaagcccaagaaggggcgcuuccugagcaaggagaagcgggccgaggagugggagagcggcaaggagcgcuuccggcuggcgaagcucaagaaggagauccuggaggcccaggagcaccccuaccacgacuucaaguccuggcagaaguucgagcgcgagcugcggcucgugaagaaccaggacaucaucaccuggaugaugugccgcgaccugauggaggagaacaaggucgaggggcuggacaccggcacccucuaccugaaggacauccggcccaacgugcaggagcagggcagccugaacgugcucaaccgcgucaagccgaugcggcugcccgugguggucuaccgcgccgacucccgggggcacgugcacaaggaggaggcgccccuggccacgguguacaucgaggagcgcgacaccaagcuccugaagcagggcaacuucaagagcuucgucaaggaccggcgccugaacgggcuguucuccuucguggacaccggcgcccuggccauggagcaguaccccaucagcaagcugcggguggaguacgagcucgccaaguaccagaccgcccgcgucugcgccuucgagcagacccuggagcuggaggagucccuccugacgcgguacccgcaccuccccgacgagagcuuccgcgagaugcucgaguccuggagcgacccccugcugaccaaguggcccgagcuccacgggaaggugcgccugcugaucgcggugcggaacgccuucucccacaaccaguacccgauguacgacgaggccgucuucagcuccaucuggaaguacgaccccagcucccccgacgccaucgaggagcgcaugggccucaacaucgcgcaccggcugagcgaggaggugaagcaggccaaggagaccaucgagcgcaucauccaggccuga

SEQ ID NO: 11207 - RNA, 3360 nt, Artificial Sequence
  Cas13b variant__Porphyromonas gulae__WP_039419792.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaaccucgacaacgaccuggagcggaagucccgccugcggagccucauccugaagcacuucuccuuccuggagggggcggccuacggcaagaagcuguucgagagcaaguccagcgggaacaaguccagcaagaacaaggagcugacgaagaaggagaaggaggagcugcaggccaacgcccucucccuggacaaccucaagagcauccucuucgacuuccugcagaagcugaaggacuuccgcaacuacuacucccacuaccggcacagcggcuccagcgagcucccgcuguucgacgggaacaugcugcagcgccucuacaacgucuucgacguguccgugcagcgggucaagcgcgaccacgagcacaacgacaagguggacccccaccggcacuucaaccaccuggugcgcaagggcaagaaggaccgguacggccacaacgacaaccccagcuucaagcaccacuucgucgacggggagggcauggugaccgaggcggggcugcuguucuucgugucccuguuccuggagaagcgcgacgccaucuggaugcagaagaagauccggggcuucaagggcgggaccgagaccuaccagcagaugacgaacgaggucuucugccgcagccggaucagccuccccaagcugaagcuggagucccuccgcaccgacgacuggaugcugcuggacaugcucaacgagcuggugcggugcccgaagccccuguacgaccgccuccgggagaaggaccgcgcccgcuuccgggugcccgucgacauccugcccgacgaggacgacaccgacggcgggggcgaggacccguucaagaacacccuggugcgccaccaggaccgguuccccuacuucgcccuccgcuacuucgaccugaagaagguguucacgagccugcgguuccacaucgaccucgggaccuaccacuucgccaucuacaagaaggucaucggcgagcagcccgaggaccgccaccugacccggaaccuguacggcuucgggcgcauccaggacuucgcggaggagcaccggcccgaggaguggaagcgccucgugcgggaccuggacuacuucgagaccggcgacaagccguacaucucccagacgacgccccacuaccacaucgagaaggggaagaucggccugcgcuucgugcccgaggggcagcaccuguggcccagcccggaggucggcaccacccggaccggccgcuccaaguacgcccaggacaagcggcucaccgccgaggccuuccugagcgugcacgagcugaugcccaugauguucuacuacuuccuccugcgcgagaaguacuccgaggaggugagcgccgagaagguccaggggcggaucaagcgcgugaucgaggacguguacgcgaucuacgacgccuucgcccgggacgagaucaacacccgcgacgagcuggacgccugccucgccgacaagggcauccgccgggggcaccuccccaagcagaugaucggcauccugucccaggagcacaagaacauggaggagaagguccgcaagaagcuccaggagaugaucgcggacaccgaccaccggcuggacaugcuggaccgccagacggaccggaagauccgcaucgggcggaagaacgccggccuccccaagagcggcgugaucgccgacuggcugguccgcgacaugaugcgguuccagccgguggccaaggacaccuccgggaagccccugaacaacagcaaggccaacuccaccgaguaccgcaugcuccagcgggcgcuggcccuguucggcggggagaaggagcgccucacccccuacuuccggcagaugaaccugacgggcgggaacaacccccacccguuccuggacgagacccgcugggagagccacaccaacauccucuccuucuaccggagcuaccugcgcgcccggaaggccuuccuggagcgcaucggccgguccgaccgcguggagaaccggcccuuccuccugcugaaggagcccaagaccgaccgccagacgcucgucgcgggcuggaaguccgaguuccaccucccccgcgggaucuucaccgaggccgugcgggacugccugaucgagaugggcuacgacgagguggggagcuacaaggaggucggcuucauggccaaggccgugccgcuguacuucgagcgcgccugcaaggaccgggugcagcccuucuacgacagccccuucaacgucggcaacagccugaagccgaagaaggggcgcuuccuguccaaggagaagcgggcggaggagugggagagcggcaaggagcgcuuccggcucgccaagcugaagaaggagauccuggaggcccaggagcaccccuaccacgacuucaaguccuggcagaaguucgagcgcgagcuccggcuggugaagaaccaggacaucaucaccuggaugaugugccgcgaccugauggaggagaacaagguggaggggcucgacaccggcacgcuguaccugaaggacauccggcccaacguccaggagcaggggagccucaacgugcugaaccgcgugaagcccaugcggcugccggucgugguguaccgcgccgacucccggggccacguccacaaggaggaggcgccccucgccaccguguacaucgaggagcgcgacaccaagcugcugaagcagggcaacuucaagagcuucgugaaggaccggcgccucaacgggcuguucuccuucgucgacaccggcgggcuggccauggagcaguaccccaucagcaagcuccggguggaguacgagcuggccaaguaccagaccgcccgcgugugcgucuucgagcugacgcuccgccuggaggagucccugcucagccgguacccccaccucccggacgaguccuuccgcgagaugcuggagagcugguccgacccccugcuggccaaguggcccgagcugcacggcaaggugcggcuccugaucgcggugcgcaacgccuucagccacaaccaguaccccauguacgacgaggccgucuucuccagcauccggaaguacgacccguccagccccgacgccaucgaggagcgcauggggcugaacaucgcgcaccggcucagcgaggaggugaagcaggccaaggagaccguggagcgcaucauccaggccuga

SEQ ID NO: 11208 - RNA, 3528 nt, Artificial Sequence
  Cas13b variant__Porphyromonas gulae__WP_039431778.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaacuucgacaacgaccucgagcggaagucccgccugcggagccugauccucaagcacuucuccuuccuggagggggcggccuacggcaagaagcuguucgagagcaaguccagcgggaacaaguccagcaagaacaaggagcucacgaagaaggagaaggaggagcugcaggccaacgcccugucccucgacaaccucaagagcauccuguucgacuuccugcagaagcugaaggacuuccgcaacuacuacucccacuaccggcacagcgaguccagcgagcugccccucuucgacggcaacaugcugcagcgccuguacaacgucuucgacguguccgugcagcgggucaagcgcgaccacgagcacaacgacaagguggacccccaccggcacuucaaccaccucgugcgcaaggggaagaaggaccgguacggccacaacgacaaccccagcuucaagcaccacuucgucgacggcgaggggauggugaccgaggcgggccugcuguucuucgugucccucuuccuggagaagcgcgacgccaucuggaugcagaagaagauccggggguucaagggcgggaccgagaccuaccagcagaugacgaacgaggucuucugccgcagccggaucagccugcccaagcucaagcuggagucccugcgcaccgacgacuggaugcuccuggacaugcugaacgagcucgugcggugcccgaagccccuguacgaccgccugcgggaggacgaccgcgccugcuuccgcgugcccgucgacauccuccccgacgaggacgacaccgacggcggcggggaggacccguucaagaacacccuggugcggcaccaggaccgcuuccccuacuucgcccugcgguacuucgaccucaagaagguguucacgagccugcgcuuccacaucgaccugggcaccuaccacuucgccaucuacaagaagaugaucggggagcagcccgaggaccggcaccucacccgcaaccuguacggcuucggccggauccaggacuucgcggaggagcaccgccccgaggaguggaagcggcugguccgcgaccucgacuacuucgagaccggggacaagccguacaucucccagacgagcccccacuaccacaucgagaagggcaagaucgggcugcgguucaugcccgagggccagcaccuguggcccuccccggagguggggaccacccgcaccggccggagcaaguacgcccaggacaagcgccugacggccgaggccuuccucuccgugcacgagcugaugcccaugauguucuacuacuuccugcuccgggagaaguacagcgaggaggucuccgccgagaaggugcagggccgcaucaagcgggugaucgaggacgucuacgcgaucuacgacgccuucgcccgcgacgagaucaacacccugaaggagcuggacgccugccucgccgacaaggggauccggcgcggccaccuccccaagcagaugaucgcgauccugagccaggagcacaaggacauggaggagaagauccgcaagaagcugcaggagaugaucgccgacaccgaccaccggcuggacaugcuggaccgccagaccgaccggaagauccgcaucgggcggaagaacgccggccuccccaaguccggggugaucgccgacuggcuggugcgcgacaugaugcgguuccagccggucgccaaggacacgagcggcaagccccugaacaacuccaaggcgaacagcaccgaguaccgcaugcuccagcgggcccuggcccuguucggcggggagaagaagcgccucacccccuacuuccggcagaugaaccugaccggcgggaacaacccccacccguuccugcacgagacgcgcugggagucccacaccaacauccucagcuucuaccgguccuaccugcgcgcccggaaggcguuccuggagcgcaucggccggagcgaccgcauggagaaccggcccuuccuccugcugaaggagcccaagaccgaccgccagacccucguggccggguggaaguccgaguuccaccucccccggggcaucuucacggaggccguccgcgacugccugaucgagaugggcuacgacgagguggggagcuaccgcgaggugggcuucauggccaaggccgucccgcuguacuucgagcgggcgugcgaggaccgcgugcagcccuucuacgacagccccuucaacguggggaacucccugaagccgaagaagggccgguuccugagcaaggaggagcgcgccgaggagugggagcggggcaaggagcgcuuccgggaccucgaggccuggucccacagcgccgcccgccggaucgaggacgcguucgccgggaucgaguacgccucccccggcaacaagaagaagaucgagcagcugcugcgcgaccucagccugugggaggccuucgaguccaagcugaagguccgggccgacaagaucaaccucgcgaagcugaagaaggagauccuggaggcccaggagcaccccuaccacgacuucaagagcuggcagaaguucgagcgcgagcuccggcuggugaagaaccaggacaucaucaccuggaugaugugccgcgaccugauggaggagaacaagguggaggggcucgacaccggcacccuguaccugaaggacauccggcccaacguccaggagcaggggucccucaacgugcugaaccgcgugaagccgaugcggcugcccgucgugguguaccgcgccgacagccggggccacguccacaaggaggaggccccgcucgcgacgguguacaucgaggagcgcgacaccaagcugcugaagcagggcaacuucaaguccuucgugaaggaccgccggcucaacgggcuguucagcuucgucgacaccggcgggcuggccauggagcaguaccccaucuccaagcuccgcguggaguacgagcuggccaaguaccagaccgcccgggugugcgucuucgagcugacccuccgccuggaggagagccugcucacgcgguacccgcaccuccccgacgaguccuuccgcaagaugcuggagagcugguccgacccccugcuggccaaguggcccgagcugcacggcaaggugcggcuccugaucgcggugcgcaacgccuucagccacaaccaguacccgauguacgacgaggccgucuucagcuccauccggaaguacgaccccagcucccccgacgccaucgaggagcgcauggggcugaacaucgcccaccggcucagcgaggaggugaagcaggcgaaggagaccguggagcgcaucauccaggucuga

SEQ ID NO: 11209 - RNA, 3528 nt, Artificial Sequence
  Cas13b variant__Porphyromonas gulae__WP_046201018.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaacuucgacaacgaccucgagcggaagucccgccugcggagccugauccucaagcacuucuccuuccuggagggggcggccuacggcaagaagcuguucgagagcaaguccagcgggaacaaguccagcaagaacaaggagcucacgaagaaggagaaggaggagcugcaggccaacgcccugucccucgacaaccucaagagcauccuguucgacuuccugcagaagcugaaggacuuccgcaacuacuacucccacuaccggcacagcgaguccagcgagcugccccucuucgacggcaacaugcugcagcgccuguacaacgucuucgacguguccgugcagcgggucaagcgcgaccacgagcacaacgacaagguggacccccaccggcacuucaaccaccucgugcgcaaggggaagaaggaccgguacggccacaacgacaaccccagcuucaagcaccacuucgucgacuccgagggcauggugaccgaggcggggcugcuguucuucgugagccucuuccuggagaagcgcgacgccaucuggaugcagaagaagauccggggcuucaagggcgggaccgagaccuaccagcagaugacgaacgaggucuucugccgcagccggaucucccugcccaagcucaagcuggagagccugcgcaccgacgacuggaugcuccuggacaugcugaacgagcucgugcggugcccgaagccccuguacgaccgccugcgggagaaggaccgcgcccgcuuccgggugcccgucgacauccuccccgacgaggacgacaccgacgggggcggcgaggacccguucaagaacacccuggugcgccaccaggaccgguuccccuacuucgcccugcgcuacuucgaccucaagaagguguucacgucccugcgguuccacaucgaccuggggaccuaccacuucgccaucuacaagaagaugaucggcgagcagcccgaggaccgccaccucacccggaaccuguacggguucggccgcauccaggacuucgcggaggagcaccggcccgaggaguggaagcgccugguccgggaccucgacuacuucgagaccggcgacaagccguacaucagccagacgacgccccacuaccacaucgagaaggggaagaucggccugcgcuucaugcccgaggggcagcaccuguggcccuccccggaggugggcaccacccggacggggcgcagcaaguacgcccaggacaagcggcugaccgccgaggccuuccucuccgugcacgagcugaugcccaugauguucuacuacuuccugcuccgcgagaaguacagcgaggaggucuccgccgagaaggugcagggccggaucaagcgcgugaucgaggacgucuacgcgaucuacgacgccuucgcccgggacgagaucaacacccugaaggagcuggacgccugccucgccgacaagggcauccgccgcgggcaccuccccaagcagaugaucgcgauccugagccaggagcacaaggacauggaggagaagauccggaagaagcugcaggagaugaucgccgacaccgaccaccgccuggacaugcuggaccggcagacggaccgcaagauccggaucggccgcaagaacgccgggcuccccaaguccggcgugaucgccgacuggcuggugcgggacaugaugcgcuuccagccggucgccaaggacaccagcgggaagccccugaacaacuccaaggcgaacagcaccgaguaccggaugcuccagcgcgcccuggcccuguucggcggcgagaagaagcggcucacccccuacuuccgccagaugaaccugaccgggggcaacaacccccacccguuccugcacgagacccggugggagucccacaccaacauccucagcuucuaccgcuccuaccugcgggcccgcaaggcguuccuggagcggaucgggcgcagcgaccggauggagaaccgccccuuccuccugcugaaggagcccaagaccgaccggcagacgcucguggccggcuggaaguccgaguuccaccucccccgcgggaucuucaccgaggccguccgcgacugccugaucgagaugggcuacgacgaggugggcagcuaccgggaggugggguucauggccaaggccgucccgcuguacuucgagcgcgcgugcgaggaccgggugcagcccuucuacgacagccccuucaacgugggcaacucccugaagccgaagaaggggcgcuuccugagcaaggaggagcgggccgaggagugggagcgcggcaaggagcgguuccgcgaccucgaggccuggucccacagcgccgcccggcgcaucgaggacgcguucgccggcaucgaguacgccucccccgggaacaagaagaagaucgagcagcugcugcgggaccucagccugugggaggccuucgaguccaagcugaagguccgcgccgacaagaucaaccucgcgaagcugaagaaggagauccuggaggcccaggagcaccccuaccacgacuucaagagcuggcagaaguucgagcgggagcuccgccuggugaagaaccaggacaucaucaccuggaugaugugccgggaccugauggaggagaacaagguggagggccucgacaccgggacgcuguaccugaaggacauccgccccaacguccaggagcagggcucccucaacgugcugaaccgggugaagccgaugcgccugcccgucgugguguaccgggccgacagccgcgggcacguccacaaggaggaggccccgcucgcgaccguguacaucgaggagcgcgacaccaagcugcugaagcagggcaacuucaaguccuucgugaaggaccggcgccucaacggccuguucagcuucgucgacaccgggggccuggccauggagcaguaccccaucuccaagcuccggguggaguacgagcuggccaaguaccagaccgcccgcgugugcgucuucgagcugacgcuccggcuggaggagagccugcucacccgcuacccgcaccuccccgacgaguccuuccggaagaugcuggagagcugguccgacccccugcuggccaaguggcccgagcugcacgggaaggugcgccuccugaucgcggugcggaacgccuucagccacaaccaguacccgauguacgacgaggccgucuucagcuccauccgcaaguacgaccccagcucccccgacgccaucgaggagcggaugggccugaacaucgcccaccgccucagcgaggaggugaagcaggcgaaggagaccguggagcggaucauccaggucuga

SEQ ID NO: 11210 - RNA, 3525 nt, Artificial Sequence
  Cas13b variant__Porphyromonas gulae__WP_039442171.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaaccucgacaacgaccuggagcggaagucccgccugcggagccucauccugaagcacuucuccuuccuggagggggcggccuacggcaagaagcuguucgagagcaaguccagcgggaacaaguccagcaagaacaaggagcugacgaagaaggagaaggaggagcugcaggccaacgcccucucccuggacaaccucaagagcauccucuucgacuuccugcagaagcugaaggacuuccgcaacuacuacucccacuaccggcacagcggcuccagcgagcucccgcuguucgacgggaacaugcugcagcgccucuacaacgucuucgacguguccgugcagcgggucaagcgcgaccacgagcacaacgacaagguggacccccacuaccacuucaaccaccuggugcggaagggcaagaaggaccgcuacggccacaacgacaaccccagcuucaagcaccacuucgucgacuccgaggggauggugaccgaggcgggccuccuguucuucgugagccuguuccuggagaagcgggacgccaucuggaugcagaagaagauccgcggguucaagggcgggaccggccccuacgagcagaugaccaacgaggucuucugccggagccgcaucucccucccgaagcugaagcuggagagccuccggacggacgacuggaugcugcuggacaugcucaacgagcuggugcgcugccccaagccccuguacgaccggcuccgcgagaaggaccgggccugcuuccgcgugcccgucgacauccugccggacgaggacgacaccgacggcgggggcgaggaccccuucaagaacacccuggugcgccaccaggaccgguuccccuacuucgcccuccgcuacuucgaccugaagaagguguucaccucccugcgguuccacaucgaccucgggacguaccacuucgccaucuacaagaagaugaucggcgagcagcccgaggaccgccaccugacccggaaccuguacggcuucgggcgcauccaggacuucgcggaggagcaccggccggaggaguggaagcgccucguccgggaccuggacuaccuggagaccggcgacaagcccuacaucagccagaccacgccccacuaccacaucgagaaggggaagaucggccugcgcuucgugcccgaggggcagcaccucuggccgucccccgaggugggcaccacccggaccggccgcagcaagugcgcccaggacaagcggcugacggccgaggccuuccuguccguccacgagcucaugcccaugauguucuacuacuuccugcugcgcgagaaguacagcgaggagguguccgccgagaaggugcaggggcggaucaagcgcgucaucgaggacguguacgcgaucuacgacgccuucgcccgggacgagaucaacacccucaaggagcuggacacgugccuggccgacaagggcauccgccgggggcaccuccccaagcagaugaucaccauccugagccaggagcgcaaggacaugaaggagaagauccgcaagaagcugcaggagaugaucgccgacacggaccaccggcucgacaugcuggaccgccagaccgaccggaagauccgcaucggccggaagaacgcggggcugccgaaguccggcgugaucgccgacuggcucguccgcgacaugaugcgguuccagcccguggccaaggacgccagcggcaagccccugaacaacuccaaggccaacagcaccgaguaccgcaugcugcagcgggcgcucgcccuguucgggggcgagaaggagcgccugacccccuacuuccggcagaugaaccucaccgggggcaacaacccgcaccccuuccugcacgagacccgcugggagucccacaccaacauccugagcuucuaccgguccuaccuccgcgcccggaaggccuuccuggagcgcaucgggcggagcgaccgcgucgagaacugccccuuccugcuccugaaggagcccaagaccgaccggcagacgcugguggcgggcuggaaggacgaguuccaccucccgcgcggcaucuucaccgaggccgugcgggacugccugaucgagaugggguacgacgaggucggcuccuaccgcgaggugggguucauggccaaggccgugccccuguacuucgagcgcgccugcgaggaccggguccagcccuucuacgacagcccguucaacgugggcaacagccucaagcccaagaagggccgcuuccuguccaaggaggaccgggcggaggagugggagcgcgggauggagcgguuccgcgaccuggaggccuggagccacuccgccgcccggcgcaucaaggacgccuucgcgggcaucgaguacgccagccccgggaacaagaagaagaucgagcagcuccugcgggaccugucccucugggaggccuucgagagcaagcugaaggugcgcgccgacaagaucaaccuggccaagcucaagaaggagauccuggaggcgcaggagcaccccuaccacgacuucaaguccuggcagaaguucgagcgggagcugcgccucgucaagaaccaggacaucaucaccuggaugaugugccgggaccugauggaggagaacaagguggagggccuggacaccgggacgcucuaccugaaggacauccgcccgaacgugcaggagcagggcagccugaacguccucaaccgggugaagcccaugcgccugcccguggucguguaccgggccgacucccgcggccacgugcacaaggaggcgccccuggccaccgucuacaucgaggagcggaacaccaagcuccugaagcaggggaacuucaagagcuucgugaaggaccgccgccugaacggccucuucuccuucguggacaccgggggccuggccauggagcaguacccgaucagcaagcugcgggucgaguacgagcucgccaaguaccagaccgcccgcgugugcguguucgagcugacgcugcggcucgaggagucccugcugagccgcuacccccaccuccccgacgaguccuuccgggagaugcuggagagcugguccgacccccugcucgccaaguggccggagcugcacgggaagguccgccugcucaucgccgugcggaacgcguucagccacaaccaguaccccauguacgacgaggccguguucagcuccauccgcaaguacgaccccagcucccccgacgccaucgaggagcggaugggccugaacaucgcccaccgccugagcgaggaggucaagcaggccaaggagaccguggagcggaucauccaggcguga

SEQ ID NO: 11211 - RNA, 3360 nt, Artificial Sequence
  Cas13b variant__Porphyromonas gulae__WP_039426176.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaacuucgacaacgaccucgagcggaagucccgccugcggagccugauccucaagcacuucuccuuccuggagggggcggccuacggcaagaagcuguucgagagcaaguccagcgggaacaaguccagcaagaacaaggagcucacgaagaaggagaaggaggagcugcaggccaacgcccugucccucgacaaccucaagagcauccuguucgacuuccuccagaagcugaaggacuuccgcaacuacuacucccacuaccggcacagcggcuccagcgagcugccgcuguucgacgggaacaugcugcagcgccuguacaacgucuucgacguguccgugcagcgggucaagcgcgaccacgagcacaacgacaagguggacccccacuaccacuucaaccaccucgugcggaagggcaagaaggaccgcuacggccacaacgacaaccccagcuucaagcaccacuucgucgacuccgaggggauggugaccgaggcgggccugcuguucuucgugagccucuuccuggagaagcgggacgccaucuggaugcagaagaagauccgcggguucaagggcgggaccggccccuacgagcagaugaccaacgaggucuucugccggagccgcaucucccugccgaagcucaagcuggagagccugcggacggacgacuggaugcuccuggacaugcugaacgagcucgugcgcugccccaagccccuguacgaccggcugcgcgagaaggaccgggccugcuuccgcgugcccgucgacauccucccggacgaggacgacaccgacggcgggggcgaggaccccuucaagaacacccuggugcgccaccaggaccgguuccccuacuucgcccugcgcuacuucgaccucaagaagguguucaccucccugcgguuccacaucgaccuggggacguaccacuucgccaucuacaagaagaugaucggcgagcagcccgaggaccgccaccucacccggaaccuguacggcuucgggcgcauccaggacuucgcggaggagcaccggccggaggaguggaagcgccugguccgggaccucgacuacuucgagaccggcgacaagcccuacaucagccagaccacgccccacuaccacaucgagaaggggaagaucggccugcgcuucaugcccgaggggcagcaccuguggccgucccccgaggugggcaccacccggaccggccgcagcaaguacgcccaggacaagcggcugacggccgaggccuuccucuccgugcacgagcugaugcccaugauguucuacuacuuccugcuccgcgagaaguacagcgaggaggucuccgccgagaaggugcaggggcggaucaagcgcgugaucaaggacgucuacgcgaucuacgacgccuucgcccgggacgagaucaacacccugaaggagcuggacgccugcagcgccgacaagggcauccgccgggggcaccuccccaagcagaugaucggcauccugucccaggagcacaagaacauggaggagaaggugcgcaagaagcugcaggagaugaucgcggacaccgaccaccgccucgacaugcuggaccggcagaccgaccgcaagauccggaucgggcgcaagaacgccggccugcccaagagcggcgugaucgccgacuggcucguccgggacaugaugcgcuuccagcccguggccaaggacacguccgggaagccccugaacaacagcaaggccaacuccaccgaguaccggaugcugcagcgcgcgcucgcccuguucggcggggagaaggagcggcugacccccuacuuccgccagaugaaccucaccggcgggaacaacccgcaccccuuccuggacgagacgcggugggagagccacaccaacauccuguccuucuaccgcagcuaccuccgggcccgcaaggccuuccuggagcggaucggccgcuccgaccgggucgagaaccgccccuuccugcuccugaaggagcccaagaacgaccggcagacccugguggcgggcuggaaguccgaguuccaccucccgcgcgggaucuucaccgaggccgugcgggacugccugaucgagaugggcuacgacgaggucgggagcuacaaggaggugggcuucauggccaaggccgugccccuguacuucgagcgcgccugcaaggaccgcguccagcccuucuacgacagcccguucaacgugggcaacagccucaagcccaagaaggggcgguuccuguccaaggagaagcgcgcggaggagugggagagcggcaaggagcgguuccgccuggccaagcucaagaaggagauccuggaggccaaggagcaccccuaccacgacuucaaguccuggcagaaguucgagcgggagcugcgccucgugaagaaccaggacaucaucacguggaugaugugccgggaccugauggaggagaacaaggucgaggggcuggacaccggcacccucuaccugaaggacauccgcaccgacgugcacgagcaggggagccugaacgugcucaaccgggucaagcccaugcgccugccggugguggucuaccgggccgacucccgcggccacgugcacaaggagcaggccccgcuggcgacgguguacaucgaggagcgggacaccaagcuccugaagcagggcaacuucaagagcuucgucaaggaccgccggcugaacgggcuguucuccuucguggacaccggcgggcuggccauggagcaguaccccaucagcaagcugcgcguggaguacgagcucgccaaguaccagaccgcccgggucugcgccuucgagcagacccuggagcuggaggagucccuccugacgcgcuacccccaccucccggacgagaacuuccgggagaugcucgagagcugguccgacccccugcugggcaaguggcccgaccuccacgggaaggugcgccugcugaucgcggugcgcaacgccuucagccacaaccaguaccccauguacgacgaggccgucuucuccagcauccggaaguacgacccguccagccccgacgccaucgaggagcgcaugggccucaacaucgcgcaccggcugagcgaggaggugaagcaggccaaggagaccguggagcgcaucauccaggccuga

SEQ ID NO: 11212 - RNA, 3528 nt, Artificial Sequence
  Cas13b variant__Porphyromonas gulae__WP_039418912.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaaccucgacaacgaccuggagcggaagucccgccugcggagccucauccugaagcacuucuccuuccuggagggggcggccuacggcaagaagcuguucgagagcaaguccagcgggaacaaguccagcaagaacaaggagcugacgaagaaggagaaggaggagcugcaggccaacgcccucucccuggacaaccucaagagcauccucuucgacuuccugcagaagcugaaggacuuccgcaacuacuacucccacuaccggcacagcggcuccagcgagcucccgcuguucgacgggaacaugcugcagcgccucuacaacgucuucgacguguccgugcagcgggucaagcgcgaccacgagcacaacgacaagguggacccccaccggcacuucaaccaccuggugcgcaagggcaagaaggaccgguacggccacaacgacaaccccagcuucaagcaccacuucgucgacuccgaggggauggugaccgaggcgggccugcuguucuucgugagccuguuccuggagaagcgcgacgccaucuggaugcagaagaagauccggggguucaagggcgggaccgagaccuaccagcagaugacgaacgaggucuucugccgcagccggaucucccuccccaagcugaagcuggagagccuccgcauggacgacuggaugcugcuggacaugcucaacgagcuggugcggugcccgaagccccuguacgaccgccuccgggaggacgaccgcgccugcuuccgcgugcccgucgacauccugcccgacgaggacgacaccgacggcggcggggaggacccguucaagaacacccuggugcggcaccaggaccgcuuccccuacuucgcccuccgguacuucgaccugaagaagguguucaccucccugcgcuuccacaucgaccucggcacguaccacuucgccaucuacaagaagaugaucggggagcagcccgaggaccggcaccugacccgcaaccuguacggcuucggccggauccaggacuucgcggaggagcaccgccccgaggaguggaagcggcucguccgcgaccuggacuacuucgagaccggggacaagccguacaucagccagaccagcccccacuaccacaucgagaagggcaagaucgggcugcgguucaugcccgagggccagcaccuguggcccagcccggagguggggacgacccgcaccggccgguccaaguacgcccaggacaagcgccucaccgccgaggccuuccugagcgugcacgagcugaugcccaugauguucuacuacuuccuccugcgggagaaguacuccgaggaggucagcgccgagaaggugcagggccgcaucaagcgggugaucgaggacgucuacgcgaucuacgacgccuucgcccgcgacgagaucaacacgcugaaggagcucgacgccugccuggccgacaaggggauccggcgcggccaccuccccaagcagaugaucgcgauccucucccaggagcacaagaacauggaggagaaggugcgcaagaagcugcaggagaugaucgccgacaccgaccaccggcuggacaugcucgaccgccagaccgaccggaagauccgcaucgggcggaagaacgccggccugcccaagagcggggugaucgccgacuggcugguccgcgacaugaugcgguuccagccgguggccaaggacgcguccggcaagccccucaacaacagcaaggccaacuccaccgaguaccgcaugcugcagcgggcccuggcccucuucggcggggagaaggagcgccugacgcccuacuuccggcagaugaaccugaccggcgggaacaacccccacccguuccuccacgacacccgcugggagagccacaccaacauccuguccuucuaccggagcuaccugcgcgcgcggaaggccuuccucgagcgcaucggccgguccgaccgcauggagaaccggcccuuccugcugcucaaggagcccaagacggaccgccagacccuggucgccggguggaaguccgaguuccaccucccccggggcaucuucaccgaggccgugcgcgacugccugaucgagaugggcuacgacgagguggggagcuaccgcgaggucggcuucauggccaaggcggugccgcuguacuucgagcgggccugcgaggaccgcgugcagcccuucuacgacucccccuucaacgucgggaacagccugaagccgaagaagggccgguuccucuccaaggaggagcgcgccgaggagugggagcggggcaaggagcgcuuccgggaccuggaggccuggagccacuccgccgcgcgccggaucgaggacgccuucgccgggaucgaguacgccagccccggcaacaagaagaagaucgagcagcugcuccgcgaccugucccugugggaggccuucgagagcaagcucaaggugcgggcggacaagaucaaccuggccaagcugaagaaggagauccucgaggcccaggagcaccccuaccacgacuucaaguccuggcagaaguucgagcgcgagcugcggcuggugaagaaccaggacaucaucaccuggaugaugugccgcgaccucauggaggagaacaaggucgaggggcuggacacgggcacccuguaccucaaggacauccggaccaacgugcaggagcaggggagccugaacgugcugaaccacgucaagcccaugcgccucccggugguggucuaccgggccgacucccgcggccacgugcacaaggaggaggcgccccuggccaccguguacaucgaggagcgggacacgaagcugcucaagcagggcaacuucaagagcuucgucaaggaccgccgccugaacgggcuguucuccuucguggacaccggcgggcucgccauggagcaguaccccaucagcaagcugcggguggaguacgagcuggccaaguaccagaccgcccgcgucugcgcguucgagcagacccucgagcuggaggagucccugcucacccgguacccccaccucccggacaagaacuuccgcaagaugcuggagagcugguccgacccccugcuggccaaguggcccgagcugcacggcaaggugcggcuccugaucgccgugcgcaacgccuucagccacaaccaguaccccauguacgacgaggccgucuucagcuccauccggaaguacgacccgagcucccccgacgcgaucgaggagcgcauggggcugaacaucgcccaccggcucagcgaggaggugaagcaggccaaggagacgguggagcgcaucauccaggccuga

SEQ ID NO: 11213 - RNA, 3528 nt, Artificial Sequence
  Cas13b variant__Porphyromonas gulae__WP_039434803.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaacuucgacaacgaccucgagcggaagucccgccugcggagccugauccucaagcacuucuccuuccuggagggggcggccuacggcaagaagcuguucgagagcaaguccagcgggaacaaguccagcaagaacaaggagcucacgaagaaggagaaggaggagcugcaggccaacgcccugucccucgacaaccucaagagcauccuguucgacuuccugcagaagcugaaggacuuccgcaacuacuacucccacuaccggcacagcggcuccagcgagcugccccucuucgacgggaacaugcugcagcgccuguacaacgucuucgacguguccgugcagcgggucaagaucgaccacgagcacaacgacgagguggacccccacuaccacuucaaccaccucgugcgcaagggcaagaaggaccgguacggccacaacgacaaccccagcuucaagcaccacuucgucgacggggagggcauggugaccgaggcggggcugcuguucuucgugucccucuuccuggagaagcgcgacgccaucuggaugcagaagaagauccggggcuucaagggcgggaccgagaccuaccagcagaugacgaacgaggucuucugccgcagccggaucagccugcccaagcucaagcuggagucccugcgcauggacgacuggaugcuccuggacaugcugaacgagcucgugcggugcccgaagccccuguacgaccgccugcgggaggacgaccgcgccugcuuccgggugcccgucgacauccuccccgacgaggacgacaccgacggcgggggcgaggacccguucaagaacacccuggugcgccaccaggaccgcuuccccuacuucgcccugcgguacuucgaccucaagaagguguucaccagccugcgcuuccacaucgaccuggggacguaccacuucgccaucuacaagaagaugaucggcgagcagcccgaggaccggcaccucacccgcaaccuguacggcuucgggcggauccaggacuucgcggaggagcaccgccccgaggaguggaagcggcugguccgcgaccucgacuacuucgagaccggcgacaagccguacaucucccagaccagcccccacuaccacaucgagaaggggaagaucggccugcgguucaugcccgaggggcagcaccuguggcccuccccggaggugggcacgacccgcaccggccggagcaaguacgcccaggacaagcgccugaccgccgaggccuuccucuccgugcacgagcugaugcccaugauguucuacuacuuccugcuccgggagaaguacagcgaggaggucuccgccgagcgcgugcaggggcggaucaagcgcgugaucgaggacgucuacgcgguguacgacgccuucgcccgggacgagaucaacacgcgcgacgagcuggacgccugccuggccgacaagggcauccggcgcgggcaccucccccgccagaugaucgcgauccugagccaggagcacaaggacauggaggagaagauccggaagaagcugcaggagaugauggccgacaccgaccaccgccucgacaugcuggaccggcagaccgaccgcaagauccggaucggccgcaagaacgccgggcugcccaaguccggcgugaucgccgacuggcucguccgggacaugaugcgcuuccagccgguggccaaggacgcgagcggcaagccccugaacaacuccaaggccaacagcaccgaguaccggaugcugcagcgcgcccucgcccuguucgggggcgagaaggagcggcugacgcccuacuuccgccagaugaaccucaccgggggcaacaacccccacccguuccugcacgagacccggugggagucccacaccaacauccugagcuucuaccgcuccuaccuccgggcgcgcaaggccuuccuggagcggaucgggcgcagcgaccgggucgagaaccgccccuuccugcuccugaaggagcccaagacggaccggcagacccugguggccggcuggaagggcgaguuccaccucccccgcgggaucuucaccgaggccgugcgcgacugccugaucgagaugggccacgacgaggucgccuccuacaaggaggugggguucauggcgaaggccgugccgcuguacuucgagcgggccugcgaggaccgcguccagcccuucuacgacagccccuucaacgugggcaacagccucaagccgaagaagggccgguuccuguccaaggaggagcgcgccgaggagugggagcgggggaaggagcgcuuccgggaccuggaggccuggagcuacuccgcggcccgccggaucgaggacgccuucgccggcaucgaguacgccagccccgggaacaagaagaagaucgagcagcuccugcgcgaccugucccucugggaggcguucgagagcaagcugaaggugcgggccgaccgcaucaaccuggccaagcucaagaaggagauccuggaggcccaggagcaccccuaccacgacuucaaguccuggcagaaguucgagcgggagcugcgccucgucaagaaccaggacaucaucaccuggaugaugugccgggaccugauggaggagaacaagguggagggccuggacacggggacccucuaccugaaggacauccgccccaacgugcaggagcagggcagccugaacguccucaaccgggugaagccgaugcgccugcccguggucguguaccgggcggacucccgcggccacgugcacaaggaggaggccccgcuggccaccgucuacaucgaggagcgcgacaccaagcuccugaagcaggggaacuucaagagcuucgugaaggaccggcgccugaacggccucuucuccuucguggacaccgggggccuggccauggagcaguaccccaucagcaagcugcgggucgaguacgagcucgccaaguaccagacggcgcgcgugugcguguucgagcugacccugcggcucgaggagucccugcugacccgcuacccgcaccuccccgacgagagcuuccgggagaugcuggaguccuggagcgacccccugcucgccaaguggcccgagcugcacgggaagguccgccugcucaucgccgugcggaacgccuucucccacaaccaguacccgauguacgacgaggccguguucagcagcauccgcaaguacgaccccuccagccccgacgcgaucgaggagcggaugggccugaacaucgcccaccgccuguccgaggaggucaagcaggccaaggagaccguggagcggaucauccaggccuga

SEQ ID NO: 11214 - RNA, 3528 nt, Artificial Sequence
  Cas13b variant__Porphyromonas sp.__WP_039428968.1__Cas13b
augaccgagcagagcgagcgccccuacaacggcaccuacuacacgcuggaggacaagcacuucugggccgccuuccucaaccuggcgcggcacaacgccuacaucacccugacccacaucgaccgccagcucgccuacuccaaggccgacaucaccaacgaccaggacgugcugagcuucaaggcccuguggaagaacuucgacaacgaccucgagcggaagucccgccugcggagccugauccucaagcacuucuccuuccuggagggggcggccuacggcaagaagcuguucgagagcaaguccagcgggaacaaguccagcaagaacaaggagcucacgaagaaggagaaggaggagcugcaggccaacgcccugucccucgacaaccucaagagcauccuguucgacuuccugcagaagcugaaggacuuccgcaacuacuacucccacuaccggcacagcgaguccagcgagcugccccucuucgacggcaacaugcugcagcgccuguacaacgucuucgacguguccgugcagcgggucaagcgcgaccacgagcacaacgacaagguggacccccaccggcacuucaaccaccucgugcgcaaggggaagaaggaccgguacggccacaacgacaaccccagcuucaagcaccacuucgucgacuccgagggcauggugaccgaggcggggcugcuguucuucgugagccucuuccuggagaagcgcgacgccaucuggaugcagaagaagauccggggcuucaagggcgggaccgagaccuaccagcagaugacgaacgaggucuucugccgcagccggaucucccugcccaagcucaagcuggagagccugcgcaccgacgacuggaugcuccuggacaugcugaacgagcucgugcggugcccgaagccccuguacgaccgccugcgggaggacgaccgcgccugcuuccgcgugcccgucgacauccuccccgacgaggacgacaccgacgggggcggcgaggacccguucaagaacacccuggugcggcaccaggaccgcuuccccuacuucgcccugcgguacuucgaccucaagaagguguucacgucccugcgcuuccacaucgaccuggggaccuaccacuucgccaucuacaagaagaugaucggcgagcagcccgaggaccggcaccucacccgcaaccuguacggguucggccggauccaggacuucgcggaggagcaccgccccgaggaguggaagcggcugguccgcgaccucgacuacuucgagaccggcgacaagccguacaucagccagacgaccccgcacuaccacaucgagaaggggaagaucggccugcgguucgugcccgaggggcagcaccuguggcccuccccggaggugggcaccacccgcacggggcggagcaaguacgcccaggacaagcgccugaccgccgaggccuuccucuccguccacgagcugaugcccaugauguucuacuacuuccugcuccgggagaaguacagcgaggagguguccgccgagaaggugcagggccgcaucaagcgggucaucgaggacguguacgcgaucuacgacgccuucgcccgcgacgagaucaacacccugaaggagcuggacgccugccucgccgacaagggcauccggcgcgggcaccuccccaagcagaugaucggcauccugagccaggagcgcaaggacauggaggagaaggugcggaagaagcugcaggagaugaucgcggacaccgaccaccgccuggacaugcuggaccggcagacggaccgcaagauccggaucgggcgcaagaacgccggccuccccaaguccggggucaucgccgacuggcuggugcgggacaugaugcgcuuccagccggucgccaaggacaccagcggcaagccccugaacaacuccaaggccaacagcaccgaguaccggaugcuccagcgcgcgcuggcccuguucggcggggagaaggagcggcucacccccuacuuccgccagaugaaccugacgggcgggaacaacccccacccguuccugcacgagacccggugggagucccacaccaacauccucagcuucuaccgcuccuaccugcgggcccgcaaggccuuccuggagcggaucggccgcagcgaccggguggagaacugccccuuccuccugcugaaggagcccaagaccgaccgccagacgcucguggcgggguggaagggcgaguuccaccucccccggggcaucuucaccgaggccguccgcgacugccugaucgagaugggguacgacgaggugggcuccuaccgcgaggugggguucauggccaaggccgucccgcuguacuucgagcgggccugcgaggaccgcgugcagcccuucuacgacagccccuucaacgugggcaacagccugaagccgaagaagggccgguuccuguccaaggaggaccgcgcggaggagugggagcgggggaaggagcgcuuccgggaccucgaggccuggagccacuccgccgcccgccggaucaaggacgccuucgcgggcaucgaguacgccagccccgggaacaagaagaagaucgagcagcugcugcgcgaccucucccugugggaggccuucgagagcaagcugaagguccgggccgacaagaucaaccucgccaagcugaagaaggagauccuggaggcgcaggagcaccccuaccacgacuucaaguccuggcagaaguucgagcgcgagcuccggcuggugaagaaccaggacaucaucaccuggaugaugugccgcgaccugauggaggagaacaagguggagggccucgacaccgggacgcuguaccugaaggacauccggcccaacguccaggagcagggcagccucaacgugcugaaccgcgugaagccgaugcggcugcccgucgugguguaccgcgccgacucccggggccacguccacaaggaggaggcgccccucgccaccguguacaucgaggagcgcgacaccaagcugcugaagcaggggaacuucaagagcuucgugaaggaccgccggcucaacggccuguucuccuucgucgacaccgggggccuggccauggagcaguaccccaucagcaagcuccgcguggaguacgagcuggccaaguaccagaccgcccgggugugcgucuucgagcugacgcuccgccuggaggagucccugcucagccgguacccgcaccuccccgacgaguccuuccgcgagaugcuggagagcugguccgacccccugcuggccaaguggcccgagcugcacgggaaggugcggcuccugaucgccgugcgcaacgcguucagccacaaccaguacccgauguacgacgaggccgucuucagcuccauccggaaguacgaccccagcucccccgacgccaucgaggagcgcaugggccugaacaucgcccaccggcucagcgaggaggugaagcaggccaaggagaccguggagcgcaucauccaggcguga

SEQ ID NO: 11215 - RNA, 3375 nt, Artificial Sequence
  Cas13b variant__Prevotella aurantiaca__WP_025000926.1__Cas13b
auggaggacgacaagaagaccaccggcagcaucuccuacgagcugaaggacaagcacuucugggccgccuuccucaaccuggcgcgccacaacguguacaucacgaucaaccacaucaacaagcugcucgagauccgggagaucgacaacgacgagaagguccuggacaucaagacccuguggcagaaggggaacaaggaccucaaccagaaggcccgccugcgggagcugaugaccaagcacuuccccuuccucgagaccgccaucuacacgaagaacaaggaggacaagaaggaggugaagcaggagaagcaggccgaggcccagagccuggagucccugaaggacugccucuuccuguuccuggacaagcuccaggaggcgcgcaacuacuacagccacuacaaguacuccgaguucagcaaggagccggaguucgaggagggccugcuggagaagauguacaacaucuucgggaacaacauccagcucgugaucaacgacuaccagcacaacaaggacaucaaccccgacgaggacuucaagcaccuggaccggaagggccaguucaaguacuccuucgccgacaacgaggggaacaucaccgagagcggccugcuguucuucgucucccuguuccuggagaagaaggacgccaucuggaugcagcagaagcucaacggcuucaaggacaaccuggagaacaagaagaagaugacccacgagguguucugccgcagccggauccugaugcccaagcuccgccuggaguccacccagacgcaggacuggauccugcucgacaugcugaacgagcugauccggugccccaagagccucuacgagcgccugcagggggacgaccgggagaaguucaaggugccguucgaccccgccgacgaggacuacaacgcggagcaggagcccuucaagaacacccugauccgccaccaggaccgguuccccuacuucguccuccgcuacuucgacuacaacgagaucuucaagaaccugcgguuccagaucgaccugggcaccuaccacuucuccaucuacaagaagcucaucgggggccagaaggaggaccgccaccugacccacaagcuguacggguucgagcggauccaggaguucgccaagcagaaccgcccggacgaguggaaggccaucgugaaggaccucgacacguacgagaccagcaacaagcgguacaucuccgagaccacgccccacuaccaccuggagaaccagaagaucggcauccgcuuccggaacggcaacaaggagaucuggcccagccugaagaccaacgacgagaacaacgagaaguccaaguacaagcucgacaagcaguaccaggccgaggccuuccugagcgugcacgagcugcuccccaugauguucuacuaccugcugcugaagaaggagaagccgaacaacgacgagaucaacgcguccaucgucgagggguucaucaagcgcgagauccgcaacaucuucaagcucuacgacgccuucgccaacggcgagaucaacaacaucgacgaccuggagaaguacugcgccgacaaggggauccccaagcggcaccuccccaagcagaugguggccauccucuacgacgagcacaaggacauggugaaggaggcgaagcgcaagcagaaggagauggucaaggacaccaagaagcugcuggccacccucgagaagcagacccagaaggagaaggaggacgacggccggaacgugaagcugcucaagagcggcgagaucgcccgcuggcuggugaacgacaugaugcgguuccagcccguccagaaggacaacgaggggaagccgcugaacaacagcaaggccaacuccacggaguaccagaugcugcagcgcagccucgcccuguacaacaacgaggagaagcccacccgguacuuccgccaggugaaccugaucgaguccaacaacccccaccccuuccucaaguggaccaagugggaggagugcaacaacauccugaccuucuacuacagcuaccugacgaagaagaucgaguuccucaacaagcugaagccggaggacuggaagaagaaccaguacuuccugaagcucaaggagcccaagaccaaccgggagacccuggugcagggcuggaagaacggguucaaccugccccgcggcaucuucaccgagcccauccgggagugguucaagcgccaccagaacaacuccaaggaguacgagaaggucgaggcgcucgaccggguggggcuggugacgaaggucaucccgcuguucuucaaggaggaguacuucaaggacaaggaggagaacuucaaggaggacacccagaaggagaucaacgacugcgugcagcccuucuacaacuuccccuacaacgugggcaacauccacaagcccaaggagaaggacuuccuccaccgcgaggagcggaucgagcugugggacaagaagaaggacaaguucaagggcuacaaggagaagaucaagagcaagaagcugaccgagaaggacaaggaggaguuccgcuccuaccucgaguuccagagcuggaacaaguucgagcgggagcugcgccugguccggaaccaggacaucgugaccuggcuccugugcaaggagcugaucgacaagcucaagaucgacgagcugaacaucgaggagcugaagaagcuccgccugaacaacaucgacacggacaccgccaagaaggagaagaacaacauccugaaccgcgucaugccgauggagcuccccgugaccguguacgagaucgacgacucccacaagaucgucaaggacaagccccugcacaccaucuacaucaaggaggccgagacgaagcugcucaagcaggggaacuucaaggcccuggugaaggaccggcgccugaacggccucuucagcuucgugaagaccaacuccgaggccgagagcaagcggaacccgaucuccaagcugcgcgucgaguacgagcugggggaguaccaggaggcgcggaucgagaucauccaggacaugcucgcccuggaggagaagcugaucaacaaguacaaggaccuccccaccaacaaguucagcgagaugcugaacuccuggcuggagggcaaggacgaggccgacaaggcccgcuuccagaacgacguggacuuccucaucgcggugcggaacgccuucagccacaaccaguaccccaugcacaacaagaucgaguucgccaacaucaagcccuucucccuguacaccgccaacaacagcgaggagaaggggcugggcaucgccaaccagcucaaggacaagaccaaggagacgaccgacaagaucaagaagaucgagaagccgaucgagaccaaggaguga

SEQ ID NO: 11216 - RNA, 3384 nt, Artificial Sequence; identical to SEQ ID NO: 11166
  Cas13b variant__Prevotella buccae__EFU31981.1__Cas13b

SEQ ID NO: 11217 - RNA, 3384 nt, Artificial Sequence
  Cas13b variant__Prevotella buccae__WP_004343581.1__Cas13b
augcagaagcaggacaagcuguucguggaccgcaagaagaacgccaucuucgccuuccccaaguacaucaccaucauggagaaccaggagaagccggagcccaucuacuacgagcucaccgacaagcacuucugggcggccuuccugaaccuggcccggcacaacgucuacacgaccaucaaccacaucaaccgccggcucgagaucgccgagcugaaggacgacggcuacaugauggacaucaaggggagcuggaacgagcaggccaagaagcuggacaagaaggugcgccuccgggaccugaucaugaagcacuuccccuuccuggaggcggccgccuacgagaucaccaacuccaagagccccaacaacaaggagcagcgcgagaaggagcaguccgaggcccucagccugaacaaccugaagaacgugcuguucaucuuccuggagaagcugcagguccuccggaacuacuacucccacuacaaguacagcgaggaguccccgaagcccaucuucgagaccagccugcugaagaacauguacaagguguucgacgcgaacgugcgccucgucaagcgggacuacaugcaccacgagaacaucgacaugcagcgcgacuucacgcaccugaaccggaagaagcaggucggccgcaccaagaacaucaucgacucccccaacuuccacuaccacuucgccgacaaggaggggaacaugaccaucgccggccugcuguucuucgugagccuguuccuggacaagaaggacgccaucuggaugcagaagaagcucaagggguucaaggacggccggaaccugcgcgagcagaugaccaacgagguguucugccggucccgcaucagccugcccaagcucaagcuggagaacgugcagacgaaggacuggaugcagcuggacaugcucaacgagcuggugcggugcccgaagucccuguacgagcgccuccgggagaaggaccgcgagagcuucaagguccccuucgacaucuucuccgacgacuacgacgccgaggaggagcccuucaagaacacccuggugcggcaccaggaccgcuuccccuacuucgugcugcgcuacuucgaccucaacgagaucuucgagcagcugcgguuccagaucgaccugggcaccuaccacuucagcaucuacaacaagcgcaucggggacgaggacgagguccggcaccucacccaccaccuguacggcuucgcgcgcauccaggacuucgcccagcagaaccagccggagguguggcggaagcuggugaaggaccucgacuacuucgaggccucccaggagcccuacauccccaagacggcgccccacuaccaccuggagaacgagaagaucgggaucaaguucugcagcacccacaacaaccuguucccgucccucaagaccgagaagaccugcaacggccgcagcaaguucaaccuggggacgcaguucaccgccgaggccuuccugagcguccacgagcuccugcccaugauguucuacuaccugcugcucaccaaggacuacucccggaaggagagcgccgacaagguggagggcaucauccgcaaggagaucuccaacaucuacgccaucuacgacgccuucgccaacggcgagaucaacagcaucgcggaccugaccugccggcugcagaagacgaacauccuccaggggcaccuccccaagcagaugaucuccauccuggagggccgccagaaggacauggagaaggaggccgagcggaagaucggggagaugaucgacgacacccagcgccggcucgaccugcugugcaagcagaccaaccagaagauccgcaucggcaagcggaacgccggccuccucaagagcgggaagaucgccgacuggcuggugaacgacaugaugcgcuuccagcccguccagaaggaccagaacaacaucccgaucaacaacuccaaggccaacagcaccgaguaccggaugcuccagcgcgcgcuggcccuguucggcuccgagaacuuccggcucaaggccuacuucaaccagaugaaccugguggggaacgacaacccccaccccuuccuggccgagacgcagugggagcaccagaccaacauccucagcuucuaccgcaacuaccuggaggcgcgcaagaaguaccugaagggccucaagccccagaacuggaagcaguaccagcacuuccugauccugaaggugcagaagaccaaccggaacacccucgucacgggguggaagaacuccuucaaccugccgcgcggcaucuucacccagcccauccgggagugguucgagaagcacaacaacagcaagcgcaucuacgaccagauccuguccuucgaccgggugggcuucgucgccaaggccaucccccucuacuucgccgaggaguacaaggacaacgugcagcccuucuacgacuacccguucaacaucgggaacaagcugaagccccagaagggccaguuccuggacaagaaggagcgcguggagcucuggcagaagaacaaggagcuguucaagaacuaccccagcgagaagaagaagaccgaccuggccuaccucgacuuccuguccuggaagaaguucgagcgggagcugcgccucaucaagaaccaggacaucgucaccuggcugauguucaaggagcuguucaacauggcgacgguggaggggcucaagaucggcgagauccaccuccgggacaucgacaccaacaccgccaacgaggagagcaacaacauccugaaccgcaucaugccgaugaagcugcccgugaagaccuacgagacggacaacaaggggaacauccugaaggagcggccccuggccaccuucuacaucgaggagaccgagaccaagguccucaagcagggcaacuucaaggugcuggccaaggaccgccggcugaacggccuccuguccuucgccgagaccacggacaucgaccuggagaagaaccccaucaccaagcucagcguggaccacgagcugaucaaguaccagaccacccgcaucuccaucuucgagaugacgcuggggcucgagaagaagcugaucaacaaguacccgacccugcccaccgacagcuuccggaacaugcucgagcgcuggcugcagugcaaggcgaaccggcccgagcugaagaacuacgucaacagccucaucgccgugcgcaacgccuucucccacaaccaguaccccauguacgacgccacccuguucgccgaggugaagaaguucacgcuguucccgagcgucgacaccaagaagaucgagcucaacaucgcgccccagcugcuggagaucgugggcaaggccaucaaggagaucgagaaguccgagaacaagaacuga

SEQ ID NO: 11218 - RNA, 3402 nt, Artificial Sequence
  Cas13b variant__Prevotella falsenii__WP_036884929.1__Cas13b
augaagaacgacaacaacagcaccaaguccaccgacuacacgcugggcgacaagcacuucugggccgccuuccucaaccuggcgcgccacaacguguacaucaccgucaaccacaucaacaaggugcuggagcucaagaacaagaaggaccaggagaucaucaucgacaacgaccaggacauccuggccaucaagacccugugggggaagguggacaccgacaucaacaagaaggaccggcuccgcgagcugaucaugaagcacuuccccuuccuggaggccgccacguaccagcagagcuccaccaacaacaccaagcagaaggaggaggagcaggccaaggcgcagagcuucgagucccucaaggacugccuguuccuguuccucgagaagcugcgggaggcccgcaacuacuacagccacuacaagcacuccaagagccuggaggagccgaagcucgaggagaagcugcuggagaacauguacaacaucuucgacaccaacguccagcucgugaucaaggacuacgagcacaacaaggacaucaaccccgaggaggacuucaagcaccugggccgggccgagggggaguucaacuacuacuucacgcgcaacaagaagggcaacaucaccgaguccgggcugcuguucuucgugagccuguuccuggagaagaaggacgccaucugggcgcagaccaagaucaagggcuucaaggacaaccgggagaacaagcagaagaugacccacgaggucuucugccgcucccggaugcuccugcccaagcugcgccucgagagcacgcagacccaggacuggauccugcuggacaugcucaacgagcugauccggugccccaagucccuguacaagcgccuccagggcgagaagcgggagaaguuccgcgugccguucgaccccgccgacgaggacuacgacgccgagcaggagcccuucaagaacacccuggugcggcaccaggaccgcuuccccuacuucgcccugcgguacuucgacuacaacgagaucuucaccaaccuccgcuuccagaucgaccuggggacguaccacuucagcaucuacaagaagcagaucggcgacaagaaggaggaccggcaccugacccacaagcucuacggguucgagcgcauccaggaguucgccaaggagaaccggccggacgaguggaaggcgcuggucaaggaccuggacaccuucgaggaguccaacgagcccuacaucagcgagaccacgccccacuaccaccucgagaaccagaagaucggcauccgcaacaagaacaagaagaagaagaagaccaucuggcccucccuggagaccaagaccacggugaacgagcgcagcaaguacaaccuggggaaguccuucaaggccgaggccuuccucagcgugcacgagcugcugccgaugauguucuacuaccuccugcugaacaaggaggagcccaacaacggcaagaucaacgccagcaaggucgagggcaucaucgagaagaagauccgggacaucuacaagcuguacggggccuucgcgaacgaggagaucaacaacgaggaggagcucaaggaguacugcgagggcaaggacaucgccauccgccaccuccccaagcagaugaucgccauccugaagaacgaguacaaggacauggccaagaaggccgaggacaagcagaagaagaugaucaaggacaccaagaagcggcucgcggcccuggacaagcaggucaagggggagguggaggacggcggccgcaacaucaagccccugaaguccgggcggaucgccagcuggcucgugaacgacaugaugcgcuuccagccggugcagcgggaccgcgacggcuacccccugaacaacuccaaggccaacagcaccgaguaccagcugcuccagcggacccuggcccuguucggguccgagcgcgagcggcucgcgcccuacuuccgccagaugaaccugaucggcaaggacaacccccacccguuccugaaggacacgaaguggaaggagcacaacaacauccucagcuucuaccgguccuaccuggaggccaagaagaacuuccuggggagccucaagcccgaggacuggaagaagaaccaguacuuccugaagcugaaggagcccaagaccaaccgcgagacccucgugcagggcuggaagaacggcuucaaccugccccgggggaucuucaccgagccgauccgcgagugguucauccggcaccagaacgaguccgaggaguacaagaaggucaaggacuucgaccgcaucggccugguggccaaggugaucccccucuucuucaaggaggacuaccagaaggagaucgaggacuacguccagcccuucuacggguaccccuucaacgugggcaacauccacaacagccaggaggggacguuccugaacaagaaggagcgggaggagcuguggaagggcaacaagaccaaguucaaggacuacaagaccaaggagaagaacaaggagaagaccaacaaggacaaguucaagaagaagacggacgaggagaaggaggaguuccgcuccuaccucgacuuccagagcuggaagaaguucgagcgcgagcugcggcuggugcgcaaccaggacaucgucaccuggcuccugugcauggagcugaucgacaagcucaagaucgacgagcugaacaucgaggagcugcagaagcuccggcugaaggacaucgacaccgacaccgccaagaaggagaagaacaacauccugaaccgcaucaugccgauggagcuccccgugaccgucuacgagacggacgacuccaacaacaucaucaaggacaagccccugcacaccaucuacaucaaggaggcggagaccaagcugcucaagcagggcaacuucaaggcccuggugaaggaccggcgccugaacggccucuucagcuucguggagaccuccagcgaggccgagcugaaguccaagccgaucagcaagucccuggucgaguacgagcucggggaguaccagcgggcccgcguggagaucaucaaggacaugcugcggcuggaggagacgcucaucgggaacgacgagaagcugcccaccaacaaguuccgccagaugcuggacaaguggcucgagcacaagaaggagaccgacgacaccgaccugaagaacgacgugaagcugcucacggagguccggaacgccuucagccacaaccaguaccccaugcgcgaccggaucgcguucgccaacaucaagcccuucagccuguccagcgccaacaccuccaacgaggagggccuggggaucgccaagaagcucaaggacaagaccaaggagaccaucgaccgcaucaucgagaucgaggagcagacggccaccaagcgguga

SEQ ID NO: 11219 - RNA, 3402 nt, Artificial Sequence
  Cas13b variant__Prevotella intermedia__BAU18623.1__Cas13b
auggaggacgacaagaagaccaccgacagcaucuccuacgagcugaaggacaagcacuucugggccgccuuccucaaccuggcgcgccacaacguguacaucacggucaaccacaucaacaaggugcuggagcucaagaacaagaaggaccaggacaucaucaucgacaacgaccaggacauccuggccaucaagacccacugggagaaggugaacggcgaccugaacaagaccgagcggcuccgcgagcugaugaccaagcacuuccccuuccuggagacggccaucuacagcaagaacaaggaggacaaggaggaggucaagcaggagaagcaggccaaggcccaguccuucgacagccucaagcacugccuguuccuguuccucgagaagcugcaggagacccggaacuacuacucccacuacaaguacagcgaguccaccaaggagccgaugcuggagaaggagcuccugaagaagauguacaacaucuucgacgacaacauccagcuggugaucaaggacuaccagcacaacaaggacaucaaccccgacgaggacuucaagcaccucgaccgcaccgaggaggacuucaacuacuacuucacgcggaacaagaaggggaacaucaccgagagcggccugcuguucuucgugucccucuuccuggagaagaaggacgcgaucuggaugcagcagaagcugcgcggguucaaggacaaccgggagagcaagaagaagaugacccacgaggucuucugccgcucccggaugcuccugcccaagcugcgccucgagagcacccagacgcaggacuggauccugcuggacaugcucaacgagcugauccggugccccaagucccuguacgagcgccuccagggcgaggaccgggagaaguucaaggugccguucgaccccgccgacgaggacuacgacgccgagcaggagcccuucaagaacacccuggugcgccaccaggaccgguuccccuacuucgcccugcgcuacuucgacuacaacgagaucuucaccaaccuccgguuccagaucgaccuggggaccuuccacuucagcaucuacaagaagcugaucggcggccagaaggaggaccgccaccucacgcacaagcuguacggguucgagcggauccaggaguucgcgaagcagaaccgcccggacgaguggaaggccaucgucaaggaccuggacaccuacgagaccuccaacgagcgguacaucagcgagaccacgccccacuaccaccucgagaaccagaagaucggcauccgcuuccgcaacgacaacgacgagaucuggcccucccugaagaccaacggggagaacaacgagaaguccaaguacaagcuggacaagcaguaccaggccgaggccuuccucagcgugcacgagcugcugcccaugauguucuacuaccuccugcugaagaaggaggagccgaacaacgacaagaagaacgccagcaucguggagggcuucaucaagcgggagauccgcgacauguacaagcuguacgacgcguucgccaacggggagaucaacaacaucgacgaccucgagaaguacugcgaggacaagggcauccccaagcggcaccuccccaagcagauggucgccauccuguacgacgagcacaaggacauggugaaggaggccaagcgcaagcagcggaagauggugaaggacaccgagaagcugcuggccgcgcuggagaagcagacccaggagaagacggaggacggcgggcgcaacauccggcuccucaagagcggcgagaucgcccgcuggcuggucaacgacaugaugcgguuccagcccgugcagaaggacaacgaggggaacccgcugaacaacuccaaggccaacagcaccgaguaccagaugcugcagcgcucccuggcccucuacaacaaggaggagaagcccacccgguacuuccgccaggugaaccugaucaacagcuccaacccccaccccuuccugaaguggaccaagugggaggagugcaacaacauccucagcuucuaccgguccuaccugacgaagaagaucgaguuccugaacaagcucaagccggaggacugggagaagaaccaguacuuccugaagcugaaggagcccaagaccaaccgcgagacccucguccagggcuggaagaacggcuucaaccugccccgggggaucuucaccgagcccauccgcgagugguucaagcggcaccagaacgacagcaaggaguacgagaagguggaggcccuggaccgcgugggccucgucacgaaggugaucccgcuguucuucaagaaggaggacuccaaggacaaggaggaggaccugaagaaggacgcgcagaaggagaucaacaacugcgugcagcccuucuacagcuuccccuacaacgucgggaacauccacaagcccgacgagaaggacuuccuccaccgggaggagcgcaucgagcugugggacaagaagaaggacaaguucaagggcuacaaggccaaggugaaguccaagaagcugaccgacaaggagaaggaggaguaccgcagcuaccucgaguuccaguccuggaacaaguucgagcgggagcugcgccugguccggaaccaggacaucgugaccuggcuccugugcaccgagcugaucgacaagcucaagguggaggggcugaacgucgaggagcugaagaagcuccgccugaaggacaucgacacggacaccgccaagcaggagaagaacaacauccugaaccgggugaugccgaugcagcuccccgugaccgucuacgagaucgacgacagccacaacaucgugaaggaccgcccccugcacaccguguacaucgaggagaccaagacgaagcugcucaagcagggcaacuucaaggcccuggucaaggaccggcgccugaacggccucuucuccuucguggacaccagcuccgaggccgagcucaagagcaacccgaucuccaagagccugguggaguacgagcugggggaguaccagaacgcgcggaucgagaccaucaaggacaugcugcugcucgaggagacccugaucgagaaguacaagaaccugcccacggacaacuucagcgacaugcucaacggcuggcuggaggggaaggacgaggccgacaaggcccgcuuccagaacgacgucaagcugcucguggccgugcggaacgcguucucccacaaccaguaccccaugcgcaaccggaucgccuucgccaacaucaaccccuucagccuguccagcgccgacaccuccgaggagaagaagcuggacaucgccaaccagcucaaggacaagacccacaagaucaucaagcgcaucaucgagaucgagaagccgaucgagaccaaggaguga

SEQ ID NO: 11220 - RNA, 3405 nt, Artificial Sequence
  Cas13b variant__Prevotella intermedia__AFJ07523.1__Cas13b
augaagauggaggacgacaagaagaccaaggagagcaccaacaugcuggacaacaagcacuucugggccgccuuccucaaccuggcgcgccacaacguguacaucacggucaaccacaucaacaaggugcuggagcucaagaacaagaaggaccaggacaucaucaucgacaacgaccaggacauccuggccaucaagacccacugggagaaggugaacggcgaccugaacaagaccgagcggcuccgcgagcugaugaccaagcacuuccccuuccuggagacggccaucuacaccaagaacaaggaggacaaggaggaggucaagcaggagaagcaggccaaggcccaguccuucgacagccucaagcacugccuguuccuguuccucgagaagcugcaggaggcgcggaacuacuacucccacuacaaguacagcgaguccaccaaggagccgaugcuggagaaggagcuccugaagaagauguacaacaucuucgacgacaacauccagcuggugaucaaggacuaccagcacaacaaggacaucaaccccgacgaggacuucaagcaccucgaccgcaccgaggaggaguucaacuacuacuucacgaccaacaagaaggggaacaucaccgccagcggccugcuguucuucgugucccucuuccuggagaagaaggacgccaucuggaugcagcagaagcugcggggguucaaggacaaccgcgagagcaagaagaagaugacccacgaggucuucugccggucccgcaugcuccugcccaagcugcggcucgagagcacgcagacccaggacuggauccugcuggacaugcucaacgagcugauccgcugccccaagucccuguacgagcggcuccagggcgaguaccgcaagaaguucaacgugccguucgacagcgccgacgaggacuacgacgcggagcaggagcccuucaagaacacccuggugcggcaccaggaccgcuuccccuacuucgcccugcgguacuucgacuacaacgagaucuucaccaaccuccgcuuccagaucgaccuggggacguaccacuucuccaucuacaagaagcugaucggcggccagaaggaggaccggcaccucacccacaagcuguacggguucgagcgcauccaggaguucgccaagcagaaccggaccgacgaguggaaggccaucgucaaggacuucgacaccuacgagacgagcgaggagcccuacaucuccgagaccgccccgcacuaccaccuggagaaccagaagaucggcauccgcuuccggaacgacaacgacgagaucuggcccagccucaagaccaacggggagaacaacgagaagcgcaaguacaagcuggacaagcaguaccaggcggaggccuuccuguccgugcacgagcuccugcccaugauguucuacuaccugcuccugaagaaggaggagcccaacaacgacaagaagaacgccagcaucguggagggcuucaucaagcgcgagauccgggacaucuacaagcuguacgacgccuucgccaacggggagaucaacaacaucgacgaccuggagaaguacugcgaggacaagggcaucccgaagcgccaccuccccaagcagauggucgcgauccuguacgacgagcacaaggacauggccgaggaggccaagcggaagcagaaggagauggugaaggacaccaagaagcugcucgccacgcuggagaagcagacccagggcgagaucgaggacgggggccgcaacauccggcugcucaaguccggggagaucgcccgcuggcuggugaacgacaugaugcgguuccagcccguccagaaggacaacgagggcaacccccugaacaacagcaaggcgaacagcaccgaguaccagaugcuccagcgcucccuggcccuguacaacaaggaggagaagccgacccgguacuuccgccaggugaaccucaucaacagcuccaacccccaccccuuccugaaguggacgaagugggaggagugcaacaacauccugagcuucuaccgguccuaccucaccaagaagaucgaguuccugaacaagcugaagcccgaggacugggagaagaaccaguacuuccucaagcugaaggagccgaagaccaaccgcgagacccuggugcagggcuggaagaacggguucaaccucccccggggcaucuucacggagcccauccgcgagugguucaagcggcaccagaacgacagcgaggaguacgagaaggucgagacccuggaccgcguggggcuggugaccaaggucaucccccucuucuucaagaaggaggacuccaaggacaaggaggaguaccugaagaaggacgcccagaaggagaucaacaacugcgugcagccguucuacggcuuccccuacaacguggggaacauccacaagcccgacgagaaggacuuccugcccagcgaggagcggaagaagcucuggggcgacaagaaguacaaguucaagggcuacaaggccaaggucaaguccaagaagcugaccgacaaggagaaggaggaguaccgcagcuaccuggaguuccaguccuggaacaaguucgagcgggagcuccgccuggugcgcaaccaggacaucgucacguggcugcucugcaccgagcugaucgacaagcugaagguggaggggcucaacguggaggagcugaagaagcugcggcucaaggacaucgacaccgacaccgccaagcaggagaagaacaacauccugaaccgcgucaugccgaugcagcugcccgugaccguguacgagaucgacgacagccacaacaucgucaaggaccggccccuccacacgguguacaucgaggagaccaagaccaagcugcugaagcagggcaacuucaaggcgcucgugaaggaccgccggcugaacgggcuguucuccuucgucgacaccagcuccgagacggagcucaagagcaacccgaucuccaagagccugguggaguacgagcugggcgaguaccagaacgcccgcaucgagaccaucaaggacaugcuccugcuggaggagacccucaucgagaaguacaagacccugcccacggacaacuucuccgacaugcugaacggguggcucgagggcaaggacgaggccgacaaggcccgguuccagaacgacgugaagcugcuggucgcggugcgcaacgccuucagccacaaccaguaccccaugcggaaccgcaucgccuucgccaacaucaaccccuucagccucuccagcgccgacaccuccgaggagaagaagcuggacaucgcgaaccagcugaaggacaagacccacaagaucaucaagcggaucaucgagaucgagaagccgaucgagaccaaggaguga

SEQ ID NO: 11221 - RNA, 3399 nt, Artificial Sequence
  Cas13b variant__Prevotella intermedia__WP_014708441.1__Cas13b
auggaggacgacaagaagaccaaggagagcaccaacaugcuggacaacaagcacuucugggccgccuuccucaaccuggcgcgccacaacguguacaucacggucaaccacaucaacaaggugcuggagcucaagaacaagaaggaccaggacaucaucaucgacaacgaccaggacauccuggccaucaagacccacugggagaaggugaacggcgaccugaacaagaccgagcggcuccgcgagcugaugaccaagcacuuccccuuccuggagacggccaucuacaccaagaacaaggaggacaaggaggaggucaagcaggagaagcaggccaaggcccaguccuucgacagccucaagcacugccuguuccuguuccucgagaagcugcaggaggcgcggaacuacuacucccacuacaaguacagcgaguccaccaaggagccgaugcuggagaaggagcuccugaagaagauguacaacaucuucgacgacaacauccagcuggugaucaaggacuaccagcacaacaaggacaucaaccccgacgaggacuucaagcaccucgaccgcaccgaggaggaguucaacuacuacuucacgaccaacaagaaggggaacaucaccgccagcggccugcuguucuucgugucccucuuccuggagaagaaggacgccaucuggaugcagcagaagcugcggggguucaaggacaaccgcgagagcaagaagaagaugacccacgaggucuucugccggucccgcaugcuccugcccaagcugcggcucgagagcacgcagacccaggacuggauccugcuggacaugcucaacgagcugauccgcugccccaagucccuguacgagcggcuccagggcgaguaccgcaagaaguucaacgugccguucgacagcgccgacgaggacuacgacgcggagcaggagcccuucaagaacacccuggugcggcaccaggaccgcuuccccuacuucgcccugcgguacuucgacuacaacgagaucuucaccaaccuccgcuuccagaucgaccuggggacguaccacuucuccaucuacaagaagcugaucggcggccagaaggaggaccggcaccucacccacaagcuguacggguucgagcgcauccaggaguucgccaagcagaaccggaccgacgaguggaaggccaucgucaaggacuucgacaccuacgagacgagcgaggagcccuacaucuccgagaccgccccgcacuaccaccuggagaaccagaagaucggcauccgcuuccggaacgacaacgacgagaucuggcccagccucaagaccaacggggagaacaacgagaagcgcaaguacaagcuggacaagcaguaccaggcggaggccuuccuguccgugcacgagcuccugcccaugauguucuacuaccugcuccugaagaaggaggagcccaacaacgacaagaagaacgccagcaucguggagggcuucaucaagcgcgagauccgggacaucuacaagcuguacgacgccuucgccaacggggagaucaacaacaucgacgaccuggagaaguacugcgaggacaagggcaucccgaagcgccaccuccccaagcagauggucgcgauccuguacgacgagcacaaggacauggccgaggaggccaagcggaagcagaaggagauggugaaggacaccaagaagcugcucgccacgcuggagaagcagacccagggcgagaucgaggacgggggccgcaacauccggcugcucaaguccggggagaucgcccgcuggcuggugaacgacaugaugcgguuccagcccguccagaaggacaacgagggcaacccccugaacaacagcaaggcgaacagcaccgaguaccagaugcuccagcgcucccuggcccuguacaacaaggaggagaagccgacccgguacuuccgccaggugaaccucaucaacagcuccaacccccaccccuuccugaaguggacgaagugggaggagugcaacaacauccugagcuucuaccgguccuaccucaccaagaagaucgaguuccugaacaagcugaagcccgaggacugggagaagaaccaguacuuccucaagcugaaggagccgaagaccaaccgcgagacccuggugcagggcuggaagaacggguucaaccucccccggggcaucuucacggagcccauccgcgagugguucaagcggcaccagaacgacagcgaggaguacgagaaggucgagacccuggaccgcguggggcuggugaccaaggucaucccccucuucuucaagaaggaggacuccaaggacaaggaggaguaccugaagaaggacgcccagaaggagaucaacaacugcgugcagccguucuacggcuuccccuacaacguggggaacauccacaagcccgacgagaaggacuuccugcccagcgaggagcggaagaagcucuggggcgacaagaaguacaaguucaagggcuacaaggccaaggucaaguccaagaagcugaccgacaaggagaaggaggaguaccgcagcuaccuggaguuccaguccuggaacaaguucgagcgggagcuccgccuggugcgcaaccaggacaucgucacguggcugcucugcaccgagcugaucgacaagcugaagguggaggggcucaacguggaggagcugaagaagcugcggcucaaggacaucgacaccgacaccgccaagcaggagaagaacaacauccugaaccgcgucaugccgaugcagcugcccgugaccguguacgagaucgacgacagccacaacaucgucaaggaccggccccuccacacgguguacaucgaggagaccaagaccaagcugcugaagcagggcaacuucaaggcgcucgugaaggaccgccggcugaacgggcuguucuccuucgucgacaccagcuccgagacggagcucaagagcaacccgaucuccaagagccugguggaguacgagcugggcgaguaccagaacgcccgcaucgagaccaucaaggacaugcuccugcuggaggagacccucaucgagaaguacaagacccugcccacggacaacuucuccgacaugcugaacggguggcucgagggcaaggacgaggccgacaaggcccgguuccagaacgacgugaagcugcuggucgcggugcgcaacgccuucagccacaaccaguaccccaugcggaaccgcaucgccuucgccaacaucaaccccuucagccucuccagcgccgacaccuccgaggagaagaagcuggacaucgcgaaccagcugaaggacaagacccacaagaucaucaagcggaucaucgagaucgagaagccgaucgagaccaaggaguga

SEQ ID NO: 11222 - RNA, 3381 nt, Artificial Sequence
  Cas13b variant__Prevotella intermedia__WP_036860899.1__Cas13b
auggaggacgacaagaagaccaccgacagcauccgcuacgagcugaaggacaagcacuucugggccgccuuccucaaccuggcgcggcacaacguguacaucacggucaaccacaucaacaagauccuggaggagggcgagaucaaccgcgacggguacgagaccacccucaagaacaccuggaacgagaucaaggacaucaacaagaaggaccggcuguccaagcugaucaucaagcacuuccccuuccucgaggccgccacguaccgccugaacccgaccgacaccaccaagcagaaggaggagaagcaggccgaggcccagagccuggagucccuccgcaagagcuucuucguguucaucuacaagcugcgggaccugcggaaccacuacucccacuacaagcacagcaagucccucgagcgccccaaguucgaggagggccugcuggagaagauguacaacaucuucaacgcgagcauccggcucgugaaggaggacuaccaguacaacaaggacaucaaccccgacgaggacuucaagcaccuggaccgcacggaggaggaguucaacuacuacuucaccaaggacaacgaggggaacaucaccgaguccggccuccucuucuucgucagccuguuccuggagaagaaggacgccaucuggaugcagcagaagcuccggggguucaaggacaaccgcgagaacaagaagaagaugaccaacgagguguucugccggucccgcaugcugcugcccaagcuccggcugcagagcacgcagacccaggacuggauccugcucgacaugcugaacgagcugauccgcugcccgaagucccucuacgagcggcugcgcgaggaggaccgggagaaguuccgcgugcccaucgagaucgccgacgaggacuacgacgccgagcaggagcccuucaagaacacccugguccggcaccaggaccgcuuccccuacuucgcgcuccgcuacuucgacuacaacgagaucuucaccaaccugcgguuccagaucgaccugggcacguaccacuucagcaucuacaagaagcagaucggcgacuacaaggagucccaccaccucacccacaagcuguacggguucgagcgcauccaggaguucaccaagcagaaccggccggacgaguggcgcaaguucgugaagaccuucaacagcuucgagacguccaaggagcccuacauccccgagaccacgccccacuaccaccuggagaaccagaagaucggcauccgguuccgcaacgacaacgacaagaucuggccgagccucaagaccaacuccgagaagaacgagaaguccaaguacaagcuggacaagagcuuccaggccgaggccuuccugagcgugcacgagcuccugcccaugauguucuacuaccugcuccugaagaccgagaacaccgacaacgacaacgagaucgagaccaagaagaaggagaacaagaacgacaagcaggagaagcacaagaucgaggagaucaucgagaacaagaucaccgagaucuacgcccuguacgacacguucgccaacggggagaucaagagcaucgacgagcucgaggaguacugcaagggcaaggacaucgagaucgggcaccuccccaagcagaugaucgcgauccugaaggacgagcacaaggucauggccaccgaggccgagcggaagcaggaggagaugcugguggacgugcagaagucccuggagagccuggacaaccagaucaacgaggagaucgagaacgucgagcgcaagaacuccagccugaaguccggcaagaucgccagcuggcucgugaacgacaugaugcgguuccagcccgugcagaaggacaacgagggcaagccgcugaacaacuccaaggccaacagcaccgaguaccagcugcuccagcgcacccuggcguucuucggguccgagcacgagcggcuggcccccuacuucaagcagacgaagcucaucgagagcuccaacccccaccccuuccugaaggacaccgagugggagaagugcaacaacauccugagcuucuaccgcuccuaccucgaggccaagaagaacuuccuggagagccugaagccggaggacugggagaagaaccaguacuuccucaagcugaaggagcccaagaccaagcccaagacccugguccagggcuggaagaacggguucaaccucccccggggcaucuucacggagccgauccgcaagugguucaugaagcaccgggagaacaucaccguggccgagcugaagcgcgugggccuggucgccaaggugaucccccucuucuucuccgaggaguacaaggacagcgugcagcccuucuacaacuaccacuucaacgucgggaacaucaacaagcccgacgagaagaacuuccugaacugcgaggagcggcgcgagcugcuccggaagaagaaggacgaguucaagaagaugaccgacaaggagaaggaggagaacccguccuaccuggaguucaagagcuggaacaaguucgagcgcgagcugcgccucgugcggaaccaggacaucgugaccuggcugcugugcauggagcuguucaacaagaagaagaucaaggagcugaacgucgagaagaucuaccugaagaacaucaacaccaacacgaccaagaaggagaagaacaccgaggagaagaacggcgaggagaagaacaucaaggagaagaacaacauccucaaccgcaucaugcccaugcggcugcccaucaagguguacgggcgcgagaacuucagcaagaacaagaagaagaagauccggcgcaacaccuucuucacggucuacaucgaggagaagggcaccaagcugcucaagcaggggaacuucaaggcgcuggagcgggaccgccggcugggcggccucuucuccuucgugaagaccccgagcaaggccgaguccaagagcaacaccaucuccaagcugcgcguggaguacgagcugggggaguaccagaaggcccggaucgagaucaucaaggacaugcucgcccuggagaagacgcugaucgacaaguacaacagccucgacaccgacaacuucaacaagaugcugaccgacuggcuggagcucaagggcgagcccgacaaggccuccuuccagaacgacgucgaccugcugaucgcggugcgcaacgccuucagccacaaccaguaccccaugcggaaccgcaucgccuucgccaacaucaaccccuucucccucagcuccgcgaacaccagcgaggagaaggggcugggcaucgccaaccagcugaaggacaagacgcacaagaccaucgagaagaucaucgagaucgagaagccgaucgagaccaaggaguga

SEQ ID NO: 11223 - RNA, 3363 nt, Artificial Sequence
  Cas13b variant__Prevotella intermedia__WP_061868553.1__Cas13b
auggaggacgacaagaagaccaccgacagcauccgcuacgagcugaaggacaagcacuucugggccgccuuccucaaccuggcgcggcacaacguguacaucacggucaaccacaucaacaagauccuggaggaggacgagaucaaccgcgacggcuacgagaacacccucgagaacuccuggaacgagaucaaggacaucaacaagaaggaccggcugagcaagcugaucaucaagcacuuccccuuccucgaggccaccaccuaccgccagaacccgacggacaccaccaagcagaaggaggagaagcaggccgaggcccagucccuggagagccugaagaaguccuucuucguguucaucuacaagcuccgggaccugcgcaaccacuacagccacuacaagcacuccaagagccuggagcggcccaaguucgaggaggaccuccagaacaagauguacaacaucuucgacguguccauccaguucgucaaggaggacuacaagcacaacaccgacaucaaccccaagaaggacuucaagcaccuggaccgcaagcggaaggggaaguuccacuacagcuucgccgacaacgagggcaacaucacggaguccgggcuccuguucuucgugagccuguuccuggagaagaaggacgcgaucugggugcagaagaagcucgagggcuucaagugcuccaacaagagcuaccagaagaugaccaacgaggucuucugccgcucccggaugcugcugcccaagcuccgccuggagagcacccagacccaggacuggauccugcucgacaugcugaacgagcugauccggugcccgaagucccucuacgagcgccugcagggggugaaccggaagaaguucuacgugagcuucgaccccgccgacgaggacuacgacgccgagcaggagcccuucaagaacacgcugguccgccaccaggaccgguuccccuacuucgcccuccgcuacuucgacuacaacgagguguucgcgaaccugcgguuccagaucgaccugggcaccuaccacuucuccaucuacaagaagcucaucggcgggcagaaggaggaccgccaccugacccacaagcuguacggcuucgagcggauccaggaguucgacaagcagaaccgcccggacgaguggaaggccaucgugaaggacagcgacaccuucaagaagaaggaggagaaggaggaggagaagcccuacaucagcgagacgacgccccacuaccaccucgagaacaagaagaucgggaucgccuucaagaaccacaacaucuggcccuccacccagaccgagcugaccaacaacaagcgcaagaaguacaaccugggcaccagcaucaaggccgaggccuuccucuccguccacgagcugcugccgaugauguucuacuaccuccugcugaagaccgagaacaccaagaacgacaacaaggucgggggcaagaaggagacgaagaagcagggcaagcacaagaucgaggcgaucaucgagagcaagaucaaggacaucuacgcccucuacgacgccuucgccaacggggagaucaacuccgaggacgagcugaaggaguaccugaagggcaaggacaucaagaucgugcaccuccccaagcagaugaucgccauccugaagaacgagcacaaggacauggcggagaaggccgaggccaagcaggagaagaugaagcuggccaccgagaaccggcugaagacccucgacaagcagcugaaggggaagauccagaacggcaagcgcuacaacagcgcccccaaguccggcgagaucgcgagcuggcuggugaacgacaugaugcgguuccagcccgugcagaaggacgagaacggggagucccucaacaacagcaaggccaacuccaccgaguaccagcugcugcagcgcacgcucgccuucuucggcagcgagcacgagcggcuggccccguacuucaagcagaccaagcugaucgaguccagcaacccccaccccuuccucaacgacaccgagugggagaagugcuccaacauccugagcuucuaccgcuccuaccugaaggcccggaagaacuuccucgagagccugaagcccgaggacugggagaagaaccaguacuuccugaugcucaaggagccgaagaccaaccgcgagacgcuggugcagggguggaagaacggcuucaaccugccccggggguucuucaccgagcccauccgcaagugguucauggagcacuggaaguccaucaaggucgacgaccucaagcgggugggccugguggcgaaggucacgccccuguucuucagcgagaaguacaaggacagcgugcagccguucuacaacuaccccuucaacgugggcgacgucaacaagcccaaggaggaggacuuccuccaccgcgaggagcggaucgagcugugggacaagaagaaggacaaguucaagggguacaaggccaagaagaaguucaaggagaugaccgacaaggagaaggaggagcaccgcuccuaccuggaguuccagagcuggaacaaguucgagcgggagcuccgccuggugcggaaccaggacaucgucaccuggcugcucugcaccgagcugaucgacaagcugaagaucgacgagcucaacaucaaggagcugaagaagcugcgccucaaggacaucaacaccgacaccgccaagaaggagaagaacaacauccugaaccgggugaugcccauggagcugccggugaccgucuacaaggugaacaagggcggguacaucaucaagaacaagccccuccacacgaucuacaucaaggaggccgagaccaagcugcugaagcagggcaacuucaaggcgcucgugaaggaccgccgccugaacgggcuguucuccuucgucaagacccccagcgaggccgaguccgagagcaacccgaucuccaagcuccggguggaguacgagcugggcaaguaccagaacgcccgccuggacaucaucgaggacaugcucgcccuggagaagaagcugaucgacaaguacaacagccucgacaccgacaacuuccacaacaugcugacgggcuggcuggagcucaagggggaggccaagaaggcgcgguuccagaacgacgugaagcugcugaccgccguccgcaacgccuucucccacaaccaguaccccauguacgacgagaaccucuucggcaacaucgagcgguucagccuguccagcuccaacaucaucgagagcaaggggcuggacaucgccgccaagcucaaggaggagguguccaaggcggccaagaagauccagaacgaggaggacaacaagaaggagaaggagaccuga

SEQ ID NO: 11224 - RNA, 3378 nt, Artificial Sequence
  Cas13b variant__Prevotella intermedia__KJJ86756.1__Cas13b
augaagauggaggacgacaagaagaccaccgagagcacgaacaugcuggacaacaagcacuucugggccgccuuccucaaccuggcgcgccacaacguguacaucaccgucaaccacaucaacaaggugcuggagcucaagaacaagaaggaccaggacaucaucaucgacaacgaccaggacauccuggccaucaagacccacugggagaaggugaacggcgaccugaacaagaccgagcggcuccgcgagcugaugacgaagcacuuccccuuccuggagaccgccaucuacaccaagaacaaggaggacaaggaggaggucaagcaggagaagcaggccgaggcccagucccucgagagccugaaggacugccuguuccucuuccuggagaagcugcaggaggcgcggaacuacuacucccacuacaaguacagcgaguccaccaaggagccgaugcucgaggaggggcugcuggagaagauguacaacaucuucgacgacaacauccagcucgugaucaaggacuaccagcacaacaaggacaucaaccccgacgaggacuucaagcaccuggaccgcaagggccaguucaaguacagcuucgccgacaacgaggggaacaucacggaguccggccuccucuucuucgugagccuguuccuggagaagaaggacgccaucuggaugcagcagaagcucaccggguucaaggacaaccgggaguccaagaagaagaugacccacgaggucuucugccgccggcgcaugcugcugcccaagcuccggcuggagagcacccagacgcaggacuggauccugcucgacaugcugaacgagcugauccgcugccccaagucccucuacgagcggcugcagggcgaguaccgcaagaaguucaacgugccguucgacagcgccgacgaggacuacgacgcggagcaggagcccuucaagaacacccuggugcggcaccaggaccgcuuccccuacuucgcccuccgguacuucgacuacaacgagaucuucaccaaccugcgcuuccagaucgaccugggcaccuaccacuucuccaucuacaagaagcucaucgggggccagaaggaggaccggcaccugacgcacaagcuguacggguucgagcgcauccaggaguucgccaagcagaaccggcccgacgaguggaaggcccucgucaaggaccuggacaccuacgagaccagcaacgagcgcuacaucuccgagaccacgccgcacuaccaccuggagaaccagaagaucggcauccgguuccgcaacgggaacaaggagaucuggcccagccucaagaccaacggcgagaacaacgagaaguccaaguacaagcuggacaagcccuaccaggccgaggcguuccugagcgugcacgagcuccugcccaugauguucuacuaccugcugcucaagaaggaggagccgaacaacgacaagaagaacgccuccaucguggagggcuucaucaagcgcgagauccgggacauguacaagcuguacgacgccuucgccaacggggagaucaacaacaucggcgaccuggagaaguacugcgaggacaaggggauccccaagcgccaccuccccaagcagauggucgccauccuguacgacgagcccaaggacauggugaaggaggcgaagcggaagcagaaggagauggugaaggacaccaagaagcugcucgccacccuggagaagcagacgcaggaggagaucgaggacggcggccgcaacauccggcugcucaagagcggggagaucgcccgcuggcuggucaacgacaugaugcgguuccagccggugcagaaggacaacgagggcaacccccugaacaacagcaaggccaacuccaccgaguaccagaugcuccagcgcagccuggcccuguacaacaaggaggagaagcccacccgguacuuccgccaggugaaccucaucaacuccagcaacccccacccguuccugaaguggaccaagugggaggagugcaacaacauccuguccuucuaccggaacuaccucacgaagaagaucgaguuccugaacaagcugaagcccgaggacugggagaagaaccaguacuuccucaagcugaaggagcccaagaccaaccgcgagacccugguccagggguggaagaacggcuucaaccucccccgggggaucuucaccgagccgauccgcgagugguucaagcggcaccagaacgacagcaaggaguacgagaagguggaggcgcugaagcgcgugggccuggucacgaaggugaucccccucuucuucaaggaggaguacuucaaggaggacgcccagaaggagaucaacaacugcgugcagcccuucuacuccuuccccuacaacgucggcaacauccacaagccggacgagaaggacuuccugcccagcgaggagcggaagaagcuguggggcgacaagaaggacaaguucaagggguacaaggccaaggugaaguccaagaagcucaccgacaaggagaaggaggaguaccgcagcuaccuggaguuccaguccuggaacaaguucgagcgggagcugcgccucguccgcaaccaggacaucgugaccuggcugcugugcaccgagcucaucgacaagaugaagguggaggggcugaacgucgaggagcugcagaagcuccggcugaaggacaucgacacggacaccgccaagcaggagaagaacaacauccugaaccgcaucaugcccaugcagcucccggugaccguguacgagaucgacgacagccacaacaucgucaaggaccggccccugcacaccguguacaucgaggagaccaagacgaagcugcucaagcagggcaacuucaaggcccuggugaaggaccgccggcugaacgggcuguucuccuucgucgacaccagcuccaaggcggagcugaaggacaagcccaucagcaaguccgugguggaguacgagcugggcgaguaccagaacgcccgcaucgagaccaucaaggacaugcuccugcuggagaagacccucaucaagaaguacgagaagcugcccacggacaacuucagcgacaugcugaacggcuggcucgaggggaaggacgaguccgacaaggcccgguuccagaacgacgucaagcugcugguggccgugcgcaacgcguucagccacaaccaguacccgaugcggaaccgcaucgccuucgccaacaucaaccccuucagccucuccagcgccgacaucuccgaggagaagaagcuggacaucgccaaccagcugaaggacaagacccacaagaucaucaagaagaucaucgagaucgagaagcccaucgagaccaaggaguga

SEQ ID NO: 11225 - RNA, 3378 nt, Artificial Sequence
  Cas13b variant__Prevotella pallens__EGQ18444.1__Cas13b
augaaggaggaggagaagggcaagacccccguggucagcaccuacaacaaggacgacaagcacuucugggccgccuuccugaaccucgcgcgccacaacguguacaucacggugaaccacaucaacaagauccugggggagggcgagaucaaccgggacggguacgagaacacccuggagaaguccuggaacgagaucaaggacaucaacaagaaggaccgccucagcaagcugaucaucaagcacuucccguuccuggaggucaccaccuaccagcggaacuccgccgacacgaccaagcagaaggaggagaagcaggccgaggcccagagccucgagucccugaagaaguccuucuucguguucaucuacaagcugcgcgaccuccggaaccacuacagccacuacaagcacagcaagucccuggagcgccccaaguucgaggaggaccugcaggagaagauguacaacaucuucgacgccagcauccagcucgugaaggaggacuacaagcacaacaccgacaucaagaccgaggaggacuucaagcaccuggaccggaagggccaguucaaguacuccuucgcggacaacgaggggaacaucacggagagcggccugcuguucuucgucucccuguuccuggagaagaaggacgccaucugggugcagaagaagcucgagggcuucaagugcagcaacgaguccuaccagaagaugaccaacgagguguucugccgcagccggaugcugcugcccaagcuccgccugcaguccacccagacccaggacuggauccugcucgacaugcugaacgagcugauccggugccccaagagccucuacgagcgccugcgggaggaggaccgcaagaaguuccgggucccgaucgagaucgccgacgaggacuacgacgccgagcaggagcccuucaagaacgcgcuggugcgccaccaggaccgguuccccuacuucgcccuccgcuacuucgacuacaacgagaucuucacgaaccugcgguuccagaucgaccuggggaccuaccacuucuccaucuacaagaagcagaucggcgacuacaaggagagccaccaccucacccacaagcuguacggguucgagcgcauccaggaguucaccaagcagaaccggcccgacgaguggcgcaaguucgugaagacguucaacagcuucgagaccuccaaggagccguacauccccgagaccacgccccacuaccaccuggagaaccagaagaucggcauccgcuuccggaacgacaacgacaagaucuggcccagccucaagaccaacuccgagaagaacgagaaguccaaguacaagcuggacaagagcuuccaggccgaggccuuccugagcguccacgagcuccugccgaugauguucuacuaccugcuccugaagaccgagaacaccgacaacgacaacgagaucgagaccaagaagaaggagaacaagaacgacaagcaggagaagcacaagaucgaggagaucaucgagaacaagaucacggagaucuacgcccuguacgacgcguucgccaacgggaagaucaacuccaucgacaagcucgaggaguacugcaagggcaaggacaucgagaucggccaccuccccaagcagaugaucgccauccucaagagcgagcacaaggacauggccaccgaggccaagcgcaagcaggaggagaugcucgcggacgugcagaagucccuggagagccuggacaaccagaucaacgaggagaucgagaacguggagcggaagaacuccagccugaaguccggggagaucgccagcuggcucgucaacgacaugaugcgcuuccagcccgugcagaaggacaacgagggcaacccccugaacaacuccaaggccaacagcaccgaguaccagaugcugcagcggucccucgcccuguacaacaaggaggagaagccgacccgcuacuuccgccaggugaaccugaucgagagcuccaacccccaccccuuccucaacaacacggagugggagaagugcaacaacauccugagcuucuaccggagcuaccuggaggccaagaagaacuuccucgagucccugaagcccgaggacugggagaagaaccaguacuuccugaugcucaaggagccgaagaccaacugcgagacccugguccagggguggaagaacggcuucaaccugccccggggcaucuucaccgagcccauccgcaagugguucauggagcaccggaagaacaucacgguggcggagcucaagcgcguggggcuggucgccaaggugaucccccuguucuucagcgaggaguacaaggacuccgugcagccguucuacaacuaccucuucaacgucggcaacaucaacaagcccgacgagaagaacuuccugaacugcgaggagcggcgcgagcugcuccggaagaagaaggacgaguucaagaagaugaccgacaaggagaaggaggagaaccccagcuaccuggaguuccaguccuggaacaaguucgagcgcgagcugcggcucgugcgcaaccaggacaucgucaccuggcugcugugcauggagcuguucaacaagaagaagaucaaggagcugaacguggagaagaucuaccugaagaacaucaacaccaacacgaccaagaaggagaagaacaccgaggagaagaacggggaggagaagaucaucaaggagaagaacaacauccucaaccggaucaugcccaugcgccugccgaucaagguguacggccgcgagaacuucagcaagaacaagaagaagaagauccggcgcaacaccuucuucaccgucuacaucgaggagaaggggacgaagcugcucaagcagggcaacuucaaggcccuggagcgggaccgccggcugggcggccucuucuccuucgugaagacccacagcaaggccgaguccaagagcaacaccaucuccaagagccgcguggaguacgagcugggggaguaccagaaggcccggaucgagaucaucaaggacaugcuggcgcucgaggagacccugaucgacaaguacaacucccuggacacggacaacuuccacaacaugcucaccggguggcugaagcugaaggacgagcccgacaaggccagcuuccagaacgacgucgaccuccugaucgccgugcgcaacgccuucucccacaaccaguaccccaugcggaaccgcaucgcguucgccaacaucaacccguucagccuguccagcgccaacaccagcgaggagaagggccucgggaucgccaaccagcugaaggacaagacccacaagacgaucgagaagaucaucgagaucgagaagcccaucgagaccaaggaguga

SEQ ID NO: 11226 - RNA, 3453 nt, Artificial Sequence
  Cas13b variant__Prevotella saccharolytica__EKY00089.1__Cas13b
augauggagaaggagaacgugcagggcagccacaucuacuacgagcccaccgacaagugcuucugggccgccuucuacaaccuggcgcgccacaacgccuaccucaccaucgcccacaucaacuccuucgucaacagcaagaaggggaucaacaacgacgacaaggugcuggacaucaucgacgacugguccaaguucgacaacgaccugcucaugggcgcccggcugaacaagcugauccucaagcacuucccguuccugaaggcgccccuguaccagcucgccaagcgcaagacgcggaagcagcaggggaaggagcagcaggacuacgagaagaagggcgacgaggaccccgaggugauccaggaggccaucgccaacgccuucaagauggcgaacguccgcaagacccugcacgccuuccugaagcagcucgaggaccugcggaaccacuucagccacuacaacuacaacucccccgccaagaagauggaggugaaguucgacgacggguucugcaacaagcuguacuacguguucgacgccgcccuccagauggucaaggacgacaaccgcaugaacccggagaucaacaugcagaccgacuucgagcaccuggugcggcugggccgcaaccggaagauccccaacaccuucaaguacaacuucacgaacagcgacggcaccaucaacaacaacgggcuccuguucuucgugucccuguuccucgagaagcgcgacgcgaucuggaugcagaagaagaucaagggcuucaagggcgggaccgagaacuacaugcggaugaccaacgaggucuucugccgcaaccggauggugauccccaagcugcgccuggagacggacuacgacaaccaccagcucauguucgacaugcugaacgagcuggugcggugcccccucagccuguacaagcgccugaagcaggaggaccaggacaaguuccgggucccgaucgaguuccucgacgaggacaacgaggccgacaaccccuaccaggagaacgccaacuccgacgagaaccccaccgaggagaccgacccccugaagaacacccuggugcgccaccagcaccgguucccguacuucgugcuccgcuacuucgaccugaacgaggucuucaagcagcugcgguuccagaucaaccucgggugcuaccacuucagcaucuacgacaagacgaucggcgagcgcaccgagaagcgccaccugacccggacccuguucggcuucgaccgccuccagaacuucuccgugaagcugcagcccgagcacuggaagaacauggugaagcaccuggacacggaggagagcuccgacaagcccuaccucagcgacgccaugccccacuaccagaucgagaacgagaagaucgggauccacuuccugaagaccgacaccgagaagaaggagaccgucuggccgucccuggagguggaggaggugagcuccaaccggaacaaguacaagagcgagaagaaccucacggccgacgcguuccuguccacccacgagcugcuccccaugauguucuacuaccagcugcugagcagcgaggagaagacccgcgccgccgccggcgacaagguccagggggugcugcaguccuaccggaagaagaucuucgacaucuacgacgacuucgccaacggcaccaucaacagcaugcagaagcucgacgagcgccuggcgaaggacaaccugcuccggggcaacaugccccagcagaugcuggccauccuggagcaccaggagcccgacauggagcagaaggccaaggagaagcucgaccgccugaucacggagaccaagaagcggaucgggaagcuggaggaccaguucaagcagaaggugcgcaucggcaagcggcgcgccgaccucccgaaggucggguccaucgccgacuggcuggugaacgacaugaugcgguuccagcccgcgaagcgcaacgccgacaacaccggcguccccgacagcaaggccaacuccaccgaguaccggcugcuccaggaggcccuggcguucuacagcgccuacaaggaccgccuggagcccuacuuccgccaggugaaccucaucgggggcacgaacccgcaccccuuccugcaccggguggacuggaagaagugcaaccaccuccuguccuucuaccacgacuaccuggaggccaaggagcaguaccugagccaccucucccccgccgacuggcagaagcaccagcacuuccugcugcucaagguccggaaggacauccagaacgagaagaaggacuggaagaagucccugguggccggcuggaagaacggguucaaccugccccgcggccucuucaccgagagcaucaagaccugguucagcaccgacgcggacaaggugcagaucacggacaccaagcuguucgagaaccgcgucgggcugaucgccaagcucaucccgcuguacuacgacaagguguacaacgacaagccccagcccuucuaccaguacccguucaacaucaacgaccgguacaagcccgaggacacccgcaagcgguucaccgccgccuccagcaagcuguggaacgagaagaagaugcucuacaagaacgcccagcccgacuccagcgacaagaucgaguacccccaguaccuggacuuccuguccuggaagaagcucgagcgcgagcugcggaugcugcgcaaccaggacaugaugguguggcucaugugcaaggaccuguucgcgcagugcacggucgagggcguggaguucgccgaccugaagcucagccagcuggagguggacgucaacgugcaggacaaccugaacgugcucaacaacgucuccagcaugauccugccgcugagcguguaccccuccgacgcccaggggaacgugcuccggaacagcaagccccugcacaccgucuacgugcaggagaacaacaccaagcugcucaagcagggcaacuucaagucccugcugaaggaccgccggcucaacggccuguucagcuucaucgccgccgagggggaggaccugcagcagcacccccucaccaagaaccgccuggaguacgagcuguccaucuaccagaccaugcggaucagcguguucgagcagacgcuccagcuggagaaggcgauccugacccgcaacaagacccucugcggcaacaacuucaacaaccugcugaacuccuggagcgagcaccggaccgacaagaagacgcuccagccggacaucgacuuccugaucgccguccgcaacgccuucucccacaaccaguaccccaugagcaccaacaccgugaugcaggggaucgagaaguucaacauccagacccccaagcuggaggagaaggacggccucgggaucgccucccagcuggcgaagaagacgaaggacgccgccagccggcugcagaacaucaucaacggcggcaccaacuga

SEQ ID NO: 11227 - RNA, 3969 nt, Artificial Sequence
  Cas13b variant__Prevotella sp.__WP_036929175.1__Cas13b
augagcaaggagugcaagaagcagcgccaggagaagaagcggcgccugcagaaggccaacuucuccaucagccugaccggcaagcacguguucggggccuacuucaacauggcgcggaccaacuucgucaagacgaucaacuacauccugcccaucgccggcgugcgcgggaacuacuccgagaaccagaucaacaagaugcugcacgcccucuuccugauccaggccggccggaacgaggagcugaccaccgagcagaagcagugggagaagaagcuccgccugaacccggagcagcagaccaaguuccagaagcugcuguucaagcacuuccccgugcuggggcccaugauggccgacgucgcggaccacaaggccuaccugaacaagaagaaguccacggugcagaccgaggacgagaccuucgccaugcucaagggcgugagccuggccgacugccuggacaucaucugccucauggcggacacccugacggagugccggaacuucuacacccacaaggaccccuacaacaagccgagccagcuggccgaccaguaccuccaccaggagaugaucgccaagaagcuggacaaggucgugguggccucccgccggauccugaaggaccgcgagggccucagcgucaacgagguggaguuccugaccgggaucgaccaccuccaccaggaggugcucaaggacgaguucggcaacgccaaggucaaggacgggaaggugaugaagaccuucguggaguacgacgacuucuacuucaagaucuccggcaagcggcuggucaacggguacacggugaccaccaaggacgacaagcccgugaacgucaacaccaugcugcccgcgcucagcgacuucggccugcuguacuucugcgugcuguuccuguccaagcccuacgccaagcuguucaucgacgaggugcgccucuucgaguacagcccguucgacgacaaggagaacaugaucauguccgagaugcugagcaucuaccggauccgcacgccccggcugcacaagaucgacucccacgacagcaaggccacccucgccauggacaucuucggcgagcugcgccggugccccauggagcuguacaaccuccuggacaagaacgccgggcagcccuucuuccacgacgaggucaagcacccgaacucccacacccccgacgugagcaagcgccugcgguacgacgaccgcuuccccacccucgcgcugcgguacaucgacgagacggagcuguucaagcgcauccgcuuccagcuccagcugggcuccuuccgguacaaguucuacgacaaggagaacugcaucgacgggcgcgugcggguccgccggauccagaaggagaucaacggcuacggccgcaugcaggagguggccgacaagcggauggacaaguggggcgaccugauccagaagcgcgaggagcggagcgucaagcucgagcacgaggagcuguacaucaaccuggaccaguuccuggaggacaccgccgacagcacccccuacgugaccgaccgccggccggccuacaacauccacgccaaccgcaucgggcucuacugggaggacucccagaaccccaagcaguacaagguguucgacgagaacgggauguacauccccgagcuggucgugacggaggacaagaaggcgcccaucaagaugccggcgccccggugcgcccugagcguguacgaccuccccgccaugcuguucuacgaguaccugcgcgagcagcaggacaacgaguuccccuccgccgagcaggucaucaucgaguacgaggacgacuaccggaaguucuucaaggccguggccgagggcaagcucaagccguucaagcgccccaaggaguuccgggacuuccugaagaaggaguaccccaagcugcgcauggccgacauccccaagaagcuccagcuguuccugugcagccacgggcucugcuacaacaacaagccggagaccguguacgagcggcuggaccgccugacccuccagcaccuggaggagcgcgagcugcacauccagaaccggcucgagcacuaccagaaggaccgcgacaugaucggcaacaaggacaaccaguacggcaagaaguccuucagcgacguccggcacggggcccuggcgcgcuaccuggcccaguccaugauggaguggcagcccaccaagcucaaggacaaggagaagggccacgacaagcugacggggcugaacuacaacgugcucaccgccuaccuggccaccuacggccacccccaggugccggaggagggguucacgccccggacccuggagcagguccucaucaacgcccaccugaucggcggcagcaacccccaccccuucaucaacaaggugcuggcgcucgggaaccgcaacaucgaggagcuguaccugcacuaccucgaggaggagcugaagcacauccggucccgcauccagagccuguccagcaacccguccgacaaggcccucagcgcccugcccuucauccaccacgaccggaugcgcuaccacgagcggaccuccgaggagaugauggcccuggccgcgcgcuacaccaccauccagcuccccgacggccuguucacgcccuacauccuggagauccuccagaagcacuacaccgagaacagcgaccugcagaacgcccugucccaggacgugccggucaagcucaacccgaccugcaacgccgccuaccugaucacccuguucuaccagaccgugcucaaggacaacgcccagcccuucuaccugagcgacaagacguacacccggaacaaggacggggagaaggcggaguccuucagcuucaagcgcgccuacgagcuguucagcgugcucaacaacaacaagaaggacaccuuccccuucgagaugaucccccuguuccugaccuccgacgagauccaggagcggcucagcgccaagcugcuggacggcgacgggaaccccguccccgaggugggcgagaagggcaagcccgccacggacucccaggggaacaccaucuggaagcgccggaucuacagcgagguggacgacuacgcggagaagcucaccgaccgcgacaugaagaucuccuucaagggcgagugggagaagcugccgcgguggaagcaggacaagaucaucaagcgccgggacgagacccgccgccagaugcgggacgagcugcuccagcgcaugccccgguacauccgcgacaucaaggacaacgagcggacgcugcgccgguacaagacccaggacaugguccuguuccuccuggccgagaagauguucaccaacaucaucagcgagcaguccagcgaguucaacuggaagcagaugcgccuguccaaggugugcaacgaggccuuccuccggcagacccugacguuccgcgugcccgucaccgugggggagaccaccaucuacguggagcaggagaacaugagccugaagaacuacggcgaguucuaccgguuccucacggacgaccgccugaugucccugcucaacaacaucgucgagacccugaagcccaacgagaacggcgaccuggugauccggcacaccgaccucaugagcgagcuggccgccuacgaccaguaccgcuccaccaucuucaugcugauccagagcaucgagaaccucaucaucacgaacaacgcggugcuggacgacccggacgccgacggguucuggguccgggaggaccugcccaagcgcaacaacuucgccucccuccuggagcugaucaaccagcucaacaacguggagcugaccgacgacgagcggaagcugcucguggccauccgcaacgccuucagccacaacuccuacaacaucgacuucagccugaucaaggacgucaagcaccuccccgagguggcgaagggcauccuccagcaccuccagagcaugcuggggguggagaucaccaaguga

SEQ ID NO: 11228 - RNA, 3384 nt, Artificial Sequence
  Cas13b variant__Prevotella sp.__WP_007412163.1__Cas13b
augcagaagcaggacaagcuguucguggaccgcaagaagaacgccaucuucgccuuccccaaguacaucaccaucauggagaaccaggagaagccggagcccaucuacuacgagcucaccgacaagcacuucugggcggccuuccugaaccuggcccggcacaacgucuacacgaccaucaaccacaucaaccgccggcucgagaucgccgagcugaaggacgacggcuacaugauggggaucaagggcagcuggaacgagcaggccaagaagcuggacaagaaggugcgccuccgggaccugaucaugaagcacuuccccuuccuggaggcggccgccuacgagaucaccaacagcaagagccccaacaacaaggagcagcgcgagaaggagcaguccgaggcccucagccugaacaaccugaagaacgugcuguucaucuuccuggagaagcugcagguccuccggaacuacuacucccacuacaaguacagcgaggaguccccgaagcccaucuucgagaccagccugcugaagaacauguacaagguguucgacgcgaacgugcgccucgucaagcgggacuacaugcaccacgagaacaucgacaugcagcgcgacuucacgcaccugaaccggaagaagcaggucgggcgcaccaagaacaucaucgacucccccaacuuccacuaccacuucgccgacaaggagggcaacaugaccaucgccgggcugcuguucuucgugagccuguuccuggacaagaaggacgccaucuggaugcagaagaagcucaagggcuucaaggacggccggaaccugcgcgagcagaugaccaacgagguguucugccggucccgcaucagccugcccaagcucaagcuggagaacgugcagacgaaggacuggaugcagcuggacaugcucaacgagcuggugcggugcccgaagucccuguacgagcgccuccgggagaaggaccgcgagagcuucaagguccccuucgacaucuucuccgacgacuacgacgccgaggaggagcccuucaagaacacccuggugcggcaccaggaccgcuuccccuacuucgugcugcgcuacuucgaccucaacgagaucuucgagcagcugcgguuccagaucgaccuggggaccuaccacuucagcaucuacaacaagcgcaucggcgacgaggacgagguccggcaccucacccaccaccuguacggguucgcgcgcauccaggacuucgccccgcagaaccagcccgaggaguggcggaagcuggugaaggaccucgaccacuucgagacgucccaggagcccuacaucagcaagaccgcgccccacuaccaccuggagaacgagaagaucggcaucaaguucugcuccacccacaacaaccuguucccgagccucaagcgcgagaagaccugcaacgggcggagcaaguucaaccugggcacgcaguucaccgccgaggccuuccuguccgugcacgagcuccugcccaugauguucuacuaccugcugcucaccaaggacuacagccgcaaggaguccgccgacaaggucgagggcaucauccggaaggagaucagcaacaucuacgccaucuacgacgccuucgccaacaacgagaucaacuccaucgccgaccugaccugccgccugcagaagacgaacauccuccaggggcaccuccccaagcagaugaucagcauccuggagggccggcagaaggacauggagaaggaggcggagcgcaagaucggggagaugaucgacgacacccagcggcgccucgaccugcugugcaagcagaccaaccagaagauccggaucggcaagcgcaacgccggccuccugaaguccgggaagaucgccgacuggcuggugagcgacaugaugcgguuccagcccgugcagaaggacaccaacaacgccccgaucaacaacuccaaggccaacagcacggaguaccgcaugcuccagcacgcgcuggcccuguucggcuccgagagcucccggcucaaggccuacuuccgccagaugaaccuggucgggaacgccaacccccaccccuuccuggcggagacccagugggagcaccagaccaacauccucagcuucuaccgcaacuaccuggaggcccggaagaaguaccugaagggccucaagccccagaacuggaagcaguaccagcacuuccugauccugaaggugcagaagaccaaccgcaacacgcucgugaccggguggaagaacuccuucaaccugccgcggggcaucuucacccagcccauccgcgagugguucgagaagcacaacaacagcaagcggaucuacgaccagauccuguccuucgaccgcgucggcuucguggccaaggccaucccccucuacuucgccgaggaguacaaggacaacguccagcccuucuacgacuacccguucaacaucgggaacaagcugaagccccagaagggccaguuccuggacaagaaggagcggguggagcucuggcagaagaacaaggagcuguucaagaacuaccccagcgagaagaacaagaccgaccuggcguaccucgacuuccuguccuggaagaaguucgagcgcgagcugcggcucaucaagaaccaggacaucgugacguggcugauguucaaggagcuguucaagaccaccaccgucgaggggcucaagaucggcgagauccaccuccgcgacaucgacacgaacaccgccaacgaggagagcaacaacauccugaaccggaucaugccgaugaagcuccccgugaagaccuacgagaccgacaacaaggggaacauccugaaggagcgcccccuggccaccuucuacaucgaggagacggagaccaaggugcucaagcagggcaacuucaagguccuggccaaggaccggcgccugaacggccuccugagcuucgccgagaccaccgacaucgaccuggagaagaaccccaucacgaagcucuccguggacuacgagcugaucaaguaccagaccacccggaucagcaucuucgagaugacccuggggcucgagaagaagcugaucgacaaguacuccacgcugccgaccgacagcuuccgcaacaugcucgagcgguggcugcagugcaaggcgaaccgccccgagcugaagaacuacgugaacucccucaucgccguccggaacgccuucagccacaaccaguaccccauguacgacgccacccuguucgccgaggugaagaaguucacccuguuccccuccguggacacgaagaagaucgagcucaacaucgcgccgcagcugcuggagaucgucggcaaggccaucaaggagaucgagaaguccgagaacaagaacuga

SEQ ID NO: 11229 - RNA, 3273 nt, Artificial Sequence
  Cas13b variant__Prevotella sp.__WP_044072147.1__Cas13b
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccaggcgucccacuacaagaccuacgacgagaagcugaucgacgggugcgaguuccucaccagcaccgagcagccccuguccggcaugaucaacaacuacuacacgguggcccugcggaacaugaacgagcgcuacggcuacaagaccgaggaccucgccuucauccaggacaagcgguucaaguucgucaaggacgccuacgggaagaagaagucccaggugaacaccggcuucuuccugagccugcaggacuacaacggggacacccagaagaagcuccaccugagcggcguggggaucgcgcugcucaucugccuguuccuggacaagcaguacaucaacaucuuccucucccgccugccgaucuucagcuccuacaacgcccagagcgaggagcggcgcaucaucauccgguccuucggcaucaacagcaucaagcagcccaaggaccgcauccacuccgagaaguccaacaagagcgucgccauggacaugcugaacgagaucaagcggugccccaacgagcuguucgagacgcugagcgccgagaagcagagccgcuuccggaucaucuccaacgaccacaacgaggugcugaugaagcgcagcuccgaccgguucgugccccuccugcugcaguacaucgacuacggcaagcuguucgaccacauccgcuuccacgucaacauggggaagcuccgguaccugcucaaggccgacaagaccugcaucgacggccagacccgcgugcgggugaucgagcagccgcugaacggguucggccgccuggaggaggucgagaccaugcgcaagcaggagaacggcacguucgggaacagcggcauccggauccgcgacuucgagaacaugaagcgggacgacgcgaaccccgccaacuaccccuacaucguggacaccuacacccacuacauccucgagaacaacaagguggagauguucaucuccgacgaggagacccccgccccgcugcugcccgucaucgaggacgaccgcuacguggugaagacgauccccagcugccggauguccacccucgagauccccgccauggccuuccacauguuccuguucgggagcaagaagaccgagaagcugaucgucgacgugcacaaccgcuacaagcgccucuucaaggcgaugcagaaggaggaggucaccgccgagaacaucgccuccuucggcaucgccgagagcgaccugccgcagaagaucaucgaccugaucuccgggaacgcccacggcaaggacguggacgcguucauccggcucacgguggacgacaugcuggccgacaccgagcggcgcaucaagcgguucaaggacgaccgcaagagcauccgguccgccgacaacaagaugggcaagcgcggguucaagcagaucagcaccggcaagcuggccgacuuccucgccaaggacaucguccuguuccagcccuccgugaacgacggggagaacaagaucaccggccugaacuaccggaucaugcagagcgcgaucgccguguacaacuccggggacgacuacgaggccaagcagcaguucaagcugauguucgagaaggcccgccucaucggcaagggcacgaccgagccccaccccuuccuguacaaggucuucgugcggagcaucccggcgaacgccguggacuucuacgagcgcuaccugaucgagcggaaguucuaccucaucgggcuguccaacgagaucaagaagggcaaccgcgucgacgugcccuucauccgccgggaccagaacaaguggaagacccccgccaugaagacccuggggcgcaucuacgacgaggaccuccccguggagcugccgcggcagauguucgacaacgagaucaagagccaccucaagagccucccccagauggagggcaucgacuucaacaacgccaacgucacguaccugaucgccgaguacaugaagcgcgugcugaacgacgacuuccagaccuucuaccaguggaagcggaacuaccgcuacauggacaugcuccgcggggaguacgaccggaagggcucccugcagagcugcuucaccuccguggaggagcgggagggccuguggaaggagcgcgcgagccggaccgagcgcuaccggaagcucgccuccaacaagauccgcagcaaccggcagaugcgcaacgccuccagcgaggagaucgagacgauccuggacaagcggcuguccaacagccgcaacgaguaccagaaguccgagaaggucauccggcgcuaccgggugcaggacgcccuccuguuccugcucgccaagaagacccugaccgagcuggcggacuucgacggggagcgcuucaagcucaaggagaucaugcccgacgccgagaagggcauccugagcgagaucaugcccauguccuucaccuucgagaagggcgggaagaaguacacgaucaccagcgagggcaugaagcugaagaacuacggggacuucuucgugcucgccuccgacaagcgcaucggcaaccugcuggagcucgucgggagcgacaccguguccaaggaggacaucauggaggaguucaagaaguacgaccagugccggccggagaucagcagcaucguguucaaccuggagaagugggccuucgacaccuaccccgagcuguccgcccgcgucgaccgggaggagaagguggacuucaagagcauccucaagauccugcugaacaacaagaacaucaacaaggagcaguccgacauccuccgcaagauccggaacgcguucgaccacaacaacuaccccgacaagggcguggucgagauccgcgcccugccggagaucgccaugagcaucaagaaggccuucggggaguacgcgaucaugaaguga

SEQ ID NO: 11230 - RNA, 3273 nt, Artificial Sequence
  Cas13b variant__Prevotella sp.__WP_042518169.1__Cas13b
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccugaccaaccacuacaagaccuacgaggagaagcucaucgacgggugcgaguuccugaccuccacggagcagccccugagcggcaugaucuccaaguacuacaccguggcgcuccggaacaccaaggagcgcuacggcuacaagaccgaggaccuggccuucauccaggacaacaucaagaagaucacgaaggacgccuacgggaagcgcaagagccaggucaacaccggcuucuuccugucccuccaggacuacaacggggacacccagaagaagcugcaccugagcggcguggggaucgcccuccugaucugccuguuccucgacaagcaguacaucaacaucuuccugucccggcugccgaucuucagcuccuacaacgcgcagagcgaggagcggcgcaucaucauccgguccuucggcaucaacagcaucaagcuccccaaggaccgcauccacuccgagaaguccaacaagagcguggccauggacaugcugaacgaggucaagcggugccccgacgagcuguucaccacgcucagcgccgagaagcagagccgcuuccggaucaucuccgacgaccacaacgaggugcugaugaagcgcagcaccgaccgguucgugccccugcuccugcaguacaucgacuacggcaagcuguucgaccacauccgcuuccacgucaacauggggaagcuccgguaccugcugaaggccgacaagaccugcaucgacggccagacccgcgugcgggugaucgagcagccgcucaacggguucggccgccuggaggaggccgagacgaugcgcaagcaggagaacggcaccuucgggaacuccggcauccggauccgcgacuucgagaacgucaagcgggacgacgcgaaccccgccaacuaccccuacaucguggacaccuacacccacuacauccuggagaacaacaagguggagauguucaucagcgacaagggguccagcgcgccccuccugccgcugaucgaggacgaccgcuacgucgugaagacgauccccuccugccggaugagcacccucgagauccccgccauggccuuccacauguuccuguucggcuccaagaagaccgagaagcugaucguggacguccacaaccgcuacaagcgccucuuccaggccaugcagaaggaggaggugaccgccgagaacaucgccagcuucgggaucgccgaguccgaccugccccagaagauccuggaccucaucagcggcaacgcccacggcaaggacgucgacgcguucauccggcugacgguggacgacaugcugaccgacaccgagcggcgcaucaagcgguucaaggacgaccgcaaguccauccggagcgccgacaacaagauggggaagcgcggcuucaagcagaucuccaccgggaagcuggccgacuuccucgccaaggacaucgugcuguuccagccgagcgucaacgacggcgagaacaagaucacggggcugaacuaccggaucaugcaguccgccaucgcgguguacgacagcggcgacgacuacgaggccaagcagcaguucaagcucauguucgagaaggcccgccugaucggcaaggggaccaccgagccccaccccuuccuguacaagguguucgcccgguccauccccgcgaacgccgucgacuucuacgagcgcuaccucaucgagcggaaguucuaccugaccggccugugcaacgagaucaagcgcgggaaccgcguggacgugccguucauccggcgcgaccagaacaaguggaagacgcccgccaugaagacccucggccggaucuacagcgaggaccugcccgucgagcugccccgccagauguucgacaacgagaucaagagccaccucaagucccugccgcagauggaggggaucgacuucaacaacgccaacgugaccuaccugaucgccgaguacaugaagcgggugcucaacgacgacuuccagaccuucuaccaguggaagcgcaacuaccacuacauggacaugcugaagggcgaguacgaccggaagggcagccugcagcacugcuucacguccgucgaggagcgcgaggggcucuggaaggagcgggcgagccgcaccgagcgguaccgcaagcuggccuccaacaagauccggagcaaccgccagaugcggaacgccuccagcgaggagaucgagaccauccuggacaagcgccucuccaacugccggaacgaguaccagaaguccgagaaggugauccgccgguaccgcgugcaggacgcccugcuguuccuccuggccaagaagacccugaccgagcucgcggacuucgacggcgagcgguucaagcugaaggagaucaugcccgacgccgagaaggggauccugagcgagaucaugcccaugagcuucacguucgagaagggcggcaagaaguacaccaucaccuccgaggggaugaagcucaagaacuacggcgacuucuucguccuggccagcgacaagcgcaucgggaaccugcucgagcuggugggcuccgacaucgugagcaaggaggacaucauggaggaguucaacaaguacgaccagugccgccccgagaucuccagcaucgucuucaaccuggagaagugggccuucgacaccuacccggagcucagcgcccggguggaccgcgaggagaagguggacuucaaguccauccugaagauccugcucaacaacaagaacaucaacaaggagcagagcgacauccugcggaagauccgcaacgcguucgaccacaacaacuaccccgacaaggggaucgucgagaucaaggcccugcccgagaucgccauguccaucaagaaggccuucggcgaguacgcgaucaugaaguga

SEQ ID NO: 11231 - RNA, 3273 nt, Artificial Sequence
  Cas13b variant__Prevotella sp.__WP_044074780.1__Cas13b
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccugaccaaccacuacaagaccuacgaggagaagcucaucgacgggugcgaguuccugaccuccacggagcagcccuucagcggcaugaucuccaaguacuacaccguggcgcugcggaacaccaaggagcgcuacggcuacaaggccgaggaccucgccuucauccaggacaaccgguacaaguucaccaaggacgccuacgggaagcgcaagagccaggucaacacgggcuccuuccugagccugcaggacuacaacggggacaccaccaagaagcuccaccuguccggcguggggaucgcgcugcucaucugccuguuccuggacaagcaguacaucaaccucuuccugagccggcugccgaucuucuccagcuacaacgcccaguccgaggagcgccggaucaucauccgcagcuucggcaucaacuccaucaagcagcccaaggaccggauccacagcgagaaguccaacaagagcguggccauggacaugcucaacgaggucaagcgcugccccgacgagcuguucaccacgcugagcgccgagaagcagucccgguuccgcaucaucagcgacgaccacaacgaggugcucaugaagcgguccagcgaccgcuucgugccccugcugcuccaguacaucgacuacggcaagcuguucgaccacauccgguuccacgucaacauggggaagcugcgcuaccuccugaaggccgacaagaccugcaucgacggccagacccgggugcgcgugaucgagcagccgcugaacggguucggccgccucgaggaggucgagaccaugcggaagcaggagaacggcacguucgggaacuccggcauccgcauccgggacuucgagaacaugaagcgcgacgacgcgaaccccgccaacuaccccuacaucguggagaccuacacccacuacauccuggagaacaacaagguggagauguucaucagcgacgaggagaaccccaccccgcugcuccccgucaucgaggacgaccgguacguggugaagacgauccccuccugccgcaugagcacccuggagauccccgccauggccuuccacauguuccuguucggguccgagaagaccgagaagcucaucaucgacguccacgaccgguacaagcgccuguuccaggccaugcagaaggaggaggugaccgcggagaacaucgccagcuucggcaucgccgaguccgaccugccgcagaagaucauggaccucaucagcgggaacgcccacggcaaggacgucgacgccuucauccggcugacgguggacgacaugcugaccgacaccgagcgccggaucaagcgcuucaaggacgaccggaaguccauccgcagcgcggacaacaagaugggcaagcggggguucaagcagaucuccaccggcaagcucgccgacuuccuggccaaggacaucgugcuguuccagcccagcgucaacgacggggagaacaagaucacgggccugaacuaccgcaucaugcaguccgccaucgccguguacgacagcggggacgacuacgaggcgaagcagcaguucaagcucauguucgagaaggcccggcugaucggcaagggcaccaccgagccccaccccuuccuguacaagguguucguccgcuccaucccggccaacgccguggacuucuacgagcgguaccucaucgagcgcaaguucuaccugaucgggcugagcaacgagaucaagaagggcaaccgcguggacguccccuucauccggcgcgaccagaacaaguggaagacccccgcgaugaagacgcucgggcggaucuacagcgaggaccugcccguggagcugccgcgccagauguucgacaacgagaucaagucccaccucaagagccugccccagauggagggcaucgacuucaacaacgccaacgugaccuaccugaucgccgaguacaugaagcggguccucaacgacgacuuccagaccuucuaccaguggaagcgcaacuaccgguacauggacaugcugcgcggggaguacgaccggaagggcucccugcagcacugcuucaccagcaucgaggagcgcgagggccucuggaaggagcgggccucccgcacggagcgguaccgcaagcuggccagcaacaagauccgguccaaccgccagaugcggaacgcgagcuccgaggagaucgagaccauccuggacaagcgccucagcaacugccggaacgaguaccagaaguccgagaagaucauccgccgguaccgcgugcaggacgcccugcuguuccuccuggccaagaagacccugaccgagcucgccgacuucgacggggagcgcuucaagcugaaggagaucaugcccgacgccgagaagggcauccugagcgagaucaugcccauguccuucaccuucgagaagggcgggaagaucuacacgaucaccagcggcgggaugaagcucaagaacuacggcgacuucuucgugcuggcguccgacaagcggaucgggaaccugcucgagcuggucggcagcaacaccguguccaaggaggacaucauggaggaguucaagaaguacgaccagugccgcccggagaucagcagcaucguguucaaccuggagaagugggccuucgacaccuaccccgagcuccccgcccgggucgaccgcaaggagaagguggacuucugguccauccuggacgugcugagcaacaacaaggacaucaacaacgagcaguccuacauccuccggaagauccgcaacgccuucgaccacaacaacuacccggacaaggggaucgucgagaucaaggcccugcccgagaucgcgaugagcaucaagaaggccuucggcgaguacgccaucaugaaguga

SEQ ID NO: 11232 - RNA, 3438 nt, Artificial Sequence
  Cas13b variant__Psychroflexus torquis__WP_015024765.1__Cas13b
auggagagcaucaucggccuggggcucuccuucaaccccuacaagaccgccgacaagcacuacuucggcagcuuccugaaccugguggagaacaaccucaacgccgucuucgcggaguucaaggagcgcaucuccuacaaggccaaggacgagaacaucagcucccugaucgagaagcacuucaucgacaacaugagcaucguggacuacgagaagaagaucuccauccugaacggguaccucccgaucaucgacuuccuggacgacgagcuggagaacaaccucaacacccgggugaagaacuucaagaagaacuucaucauccuggccgaggccaucgagaagcugcgcgacuacuacacgcacuucuaccacgaccccaucaccuucgaggacaacaaggagccccuccuggagcugcucgacgagguccugcugaagaccauccucgacgugaagaagaaguaccugaagaccgacaagacgaaggagauccugaaggacagccuccgggaggagauggaccugcuggugauccgcaagaccgacgagcuccgggagaagaagaagaccaaccccaagauccagcacaccgacuccagccagaucaagaacuccaucuucaacgacgccuuccagggccugcuguacgaggacaaggggaacaacaagaagacgcaggucagccaccgcgcgaagacccggcucaacccgaaggacauccacaagcaggaggagcgcgacuucgagaucccccuguccaccagcggccugguguuccucaugucccuguuccugagcaagaaggagaucgaggacuucaaguccaacaucaagggcuucaaggggaagguggucaaggacgagaaccacaacagccucaaguacauggccacccaccggguguacuccauccuggccuucaagggccugaaguaccgcaucaagacggacaccuucagcaaggagacccucaugaugcagaugaucgacgagcugagcaaggugcccgacugcgucuaccagaaccuguccgagaccaagcagaaggacuucaucgaggacuggaacgaguacuucaaggacaacgaggagaacacggagaaccucgagaacagccggguggugcaccccgucauccgcaagcgguacgaggacaaguucaacuacuucgccauccgcuuccuggacgaguucgcgaacuucaagacccugaaguuccagguguucaugggguacuacauccacgaccagcggaccaagaccaucggcacgaccaacaucaccaccgagcgcacggugaaggagaagaucaacgucuucgggaagcucuccaagauggacaaccugaagaagcacuucuucagccagcuguccgacgacgagaacaccgacugggaguucuucccgaaccccagcuacaacuuccucacccaggccgacaacucccccgccaacaacauccccaucuaccuggagcugaagaaccagcagaucaucaaggagaaggacgccaucaaggccgaggugaaccagacccagaaccggaacccgaacaagcccagcaagcgcgaccuccugaacaagauccugaagacguacgaggacuuccaccagggcgaccccaccgcgauccugucccucaacgagauccccgcccugcugcaccucuuccuggugaagccgaacaacaagaccggccagcagaucgagaacaucauccggaucaagaucgagaagcaguucaaggccaucaaccaccccagcaagaacaacaaggggauccccaagucccuguucgccgacaccaacguccgcgugaacgccaucaagcucaagaaggaccuggaggcggagcuggacaugcucaacaagaagcacaucgccuucaaggagaaccagaaggccagcuccaacuacgacaagcugcugaaggagcaccaguucacgcccaagaacaagcggccggagcuccgcaaguacguguucuacaagagcgagaagggcgaggaggccaccuggcuggccaacgacaucaagcgcuucaugcccaaggacuucaagaccaaguggaaggggugccagcacuccgagcugcagcggaagcucgcguucuacgaccgccacaccaagcaggacaucaaggagcugcugagcggcugcgaguucgaccacucccuccuggacaucaacgccuacuuccagaaggacaacuucgaggacuucuucagcaaguaccuggagaaccggaucgagacgcucgagggcguccugaagaagcugcacgacuucaagaacgagcccacgccccucaaggggguguucaagaacugcuucaaguuccugaagcgccagaacuacgucaccgaguccccggagaucaucaagaagcggauccuggccaagcccaccuuccucccccgcggcguguucgacgagcggcccaccaugaagaaggggaagaacccgcugaaggacaagaacgaguucgccgagugguucguggaguaccuggagaacaaggacuaccagaaguucuacaacgccgaggaguaccgcaugcgggacgcggacuucaagaagaacgccgucaucaagaagcagaagcucaaggacuucuacacccugcagauggugaacuaccugcucaaggagguguucggcaaggacgagaugaaccugcagcugagcgagcuguuccagacccgccaggagcggcucaagcugcaggggaucgccaagaagcagaugaacaaggagaccggcgacagcuccgagaacacccgcaaccagacguacaucuggaacaaggacguccccgugagcuucuucaacggcaaggugaccaucgacaaggucaagcucaagaacaucgggaaguacaagcgguacgagcgcgacgagcgggugaagaccuucaucggcuacgagguggacgagaaguggaugauguaccugccccacaacuggaaggaccgcuacuccgucaagccgaucaacgugaucgaccugcagauccaggaguacgaggagauccggagccacgagcuccugaaggagauccagaaccuggagcaguacaucuacgaccacaccacggacaagaacauccuccugcaggacgggaaccccaacuucaagauguacgugcugaacggccuccugaucgggaucaagcaggucaacauccccgacuucaucgugcugaagcagaacaccaacuucgacaagaucgacuucaccggcaucgccuccugcagcgagcucgagaagaagaccaucauccugaucgcgauccgcaacaaguucgcccacaaccagcugcccaacaagaugaucuacgaccucgccaacgaguuccugaagaucgagaagaacgagacguacgccaacuacuaccugaaggugcucaagaagaugaucuccgaccuggccuga

SEQ ID NO: 11233 - RNA, 2847 nt, Artificial Sequence
  Cas13b variant__Riemerella anatipestifer__WP_049354263.1__Cas13b
auguucuucagcuuccacaacgcccagcgcgugaucuucaagcaccuguacaaggccuucgacgcgucccuccggauggucaaggaggacuacaaggcccacuucaccgugaaccugacccgcgacuucgcccaccugaaccggaagggcaagaacaagcaggacaaccccgacuucaaccgcuaccgguucgagaaggacggguucuucacggagagcggccuccuguucuucaccaaccuguuccucgacaagcgcgacgccuacuggaugcugaagaagguguccggguucaaggccagccacaagcagcgggagaagaugaccaccgaggucuucugccgcucccggauccugcucccgaagcugcgccuggagagccgguacgaccacaaccagaugcuccuggacaugcuguccgagcucagccgcugccccaagcugcuguacgagaagcucuccgaggagaacaagaagcacuuccagguggaggcggacggcuuccuggacgagaucgaggaggagcagaaccccuucaaggacacgcugauccggcaccaggaccgcuuccccuacuucgcccuccgguaccuggaccugaacgagagcuucaaguccauccgcuuccagguggaccucgggaccuaccacuacugcaucuacgacaagaagaucggcgacgagcaggagaagcggcaccugacccgcacccugcucagcuucggccggcugcaggacuucacggagaucaaccgcccgcaggaguggaaggcccugaccaaggaccucgacuacaaggagaccuccaaccagcccuucaucagcaagaccacgccccacuaccacaucaccgacaacaagaucggguuccggcugggcaccuccaaggagcuguaccccagccucgagaucaaggacggggccaaccgcaucgcgaaguacccguacaacuccggcuucgucgcccacgccuucaucagcgugcacgagcugcugccccucauguucuaccagcaccugaccgggaaguccgaggaccugcucaaggagacggugcgccacauccagcggaucuacaaggacuucgaggaggagcgcaucaacaccaucgaggaccuggagaaggccaaccagggccggcugccccucggcgccuuccccaagcagaugcuggggcugcuccagaacaagcagccggaccugagcgagaaggcgaagaucaagaucgagaagcugaucgccgagaccaagcuccugagccaccgccugaacaccaagcugaaguccagccccaagcucggcaagcggcgcgagaagcugaucaagacggggguccuggccgacuggcucgugaaggacuucaugcgguuccagcccguggccuacgacgcccagaaccagcccaucaaguccagcaaggcgaacuccaccgaguucugguucauccgccgggcccuggcccuguacggcggcgagaagaaccgccucgagggguacuucaagcagaccaaccugaucggcaacaccaacccgcaccccuuccugaacaaguucaacuggaaggccugccggaaccucgucgacuucuaccagcaguaccuggagcagcgcgagaaguuccuggaggccaucaagaaccagcccugggagcccuaccaguacugccuccugcugaagaucccgaaggagaaccggaagaaccucgugaaggggugggagcagggcgggaucagccugccccgcggccuguucacggaggcgauccgggagacccucuccgaggaccugaugcugagcaagcccauccgcaaggagaucaagaagcacggccgggugggguucaucucccgcgccaucacccucuacuucaaggagaaguaccaggacaagcaccagagcuucuacaaccuguccuacaagcuggaggccaaggcgccccuccugaagcgggaggagcacuacgaguacuggcagcagaacaagccgcagagccccaccgagucccagcgccuggagcuccacacgagcgaccgcuggaaggacuaccugcuguacaagcgguggcagcaccucgagaagaagcugcgccuguaccggaaccaggacgucaugcucuggcugaugacccuggagcucaccaagaaccacuucaaggagcugaaccugaacuaccaccagcucaagcuggagaaccuggccgugaacgugcaggaggccgacgccaagcucaacccccugaaccagacccugcccaugguccucccggugaagguguaccccgccacggccuucggcgagguccaguaccacaagacccccauccgcaccguguacauccgggaggagcacaccaaggcgcugaagauggggaacuucaaggcccuggugaaggaccgccggcucaacggccuguucuccuucaucaaggaggagaacgacacgcagaagcacccgaucagccagcugcgccuccggcgcgagcuggagaucuaccagucccugcgggucgacgccuucaaggagacccucagccuggaggagaagcugcucaacaagcacaccucccugagcagccuggagaacgaguuccgcgcccuccuggaggaguggaagaaggaguacgccgcguccagcauggugaccgacgagcacaucgccuucaucgccuccguccggaacgccuucugccacaaccaguaccccuucuacaaggaggcccugcacgcgcccaucccccucuucaccguggcccagccgacgaccgaggagaaggacgggcugggcaucgccgaggcccugcucaaggugcugcgcgaguacugcgagaucgucaagagccagaucuga

SEQ ID NO: 11234 - RNA, 3288 nt, Artificial Sequence
  Cas13b variant__Riemerella anatipestifer__WP_004919755.1__Cas13b
auggagaagccccugcucccgaacguguacacccugaagcacaaguucuucuggggcgccuuccugaacaucgcccgccacaacgcguucaucaccaucugccacaucaacgagcagcucgggcugaagacgcccagcaacgacgacaagaucguggacguggugugcgagaccuggaacaacauccugaacaacgaccacgaccuccugaagaagucccagcugaccgagcucauccugaagcacuuccccuuccugaccgccaugugcuaccacccgcccaagaaggagggcaagaagaaggggcaccagaaggagcagcagaaggagaaggagagcgaggcccagucccaggccgaggcccucaaccccagcaagcugaucgaggcgcuggagauccucgucaaccagcugcacucccugcggaacuacuacagccacuacaagcacaagaagcccgacgccgagaaggacaucuucaagcaccucuacaaggccuucgacgccucccugcgcauggugaaggaggacuacaaggcgcacuucacggugaaccugacccgggacuucgcccaccucaaccgcaagggcaagaacaagcaggacaaccccgacuucaaccgguaccgcuucgagaaggacggguucuucaccgagagcggccugcuguucuucaccaaccucuuccuggacaagcgggacgccuacuggaugcugaagaaggucuccggcuucaaggccagccacaagcagcgcgagaagaugacgaccgagguguucugccggucccgcauccuccugccgaagcugcggcucgagagccgcuacgaccacaaccagaugcugcuggacaugcucuccgagcugagccggugccccaagcugcucuacgagaagcuguccgaggagaacaagaagcacuuccagguggaggccgacggguuccuggacgagaucgaggaggagcagaaccccuucaaggacacccucauccgccaccaggaccgguuccccuacuucgcgcugcgcuaccuggaccucaacgagagcuucaaguccauccgguuccaggucgaccugggcaccuaccacuacugcaucuacgacaagaagaucggggacgagcaggagaagcgccaccugacgcggacccuccugagcuucggccgccugcaggacuucaccgagaucaaccggccgcaggaguggaaggcccucaccaaggaccuggacuacaaggagacguccaaccagcccuucaucagcaagaccacgccccacuaccacaucaccgacaacaagaucggguuccgccugggcaccagcaaggagcuguaccccucccucgagaucaaggacggcgccaaccgcaucgccaaguacccguacaacagcggguucguggcccacgcguucaucuccgugcacgagcugcugccccucauguucuaccagcaccugaccggcaagagcgaggaccugcucaaggagaccguccggcacauccagcgcaucuacaaggacuucgaggaggagcggaucaacaccaucgaggaccuggagaaggccaaccaggggcgccugccccucggcgccuuccccaagcagaugcugggccugcuccagaacaagcagccggaccuguccgagaaggccaagaucaagaucgagaagcugaucgccgagacgaagcuccugagccaccggcugaacaccaagcucaaguccagccccaagcuggggaagcgccgggagaagcugaucaagaccggcgugcucgcggacuggcuggugaaggacuucaugcgcuuccagcccgucgccuacgacgcccagaaccagcccaucaaguccagcaaggccaacuccaccgaguucugguucauccggcgcgcccuggcgcucuacgggggcgagaagaaccggcuggagggguacuucaagcagacgaaccugaucggcaacaccaacccgcaccccuuccucaacaaguucaacuggaaggccugccgcaaccugguggacuucuaccagcaguaccuggagcagcgggagaaguuccucgaggccaucaagaaccagcccugggagcccuaccaguacugccugcugcucaagaucccgaaggagaaccgcaagaaccuggugaagggcugggagcagggcgggaucagccugccccggggccucuucaccgaggccauccgcgagacccuguccgaggaccugaugcucagcaagcccauccggaaggagaucaagaagcacgggcgcgucggguucaucucccgggcgaucacgcuguacuucaaggagaaguaccaggacaagcaccagagcuucuacaaccuguccuacaagcucgaggccaaggccccgcugcugaagcgcgaggagcacuacgaguacuggcagcagaacaagccccagagccccaccgagucccagcgccucgagcugcacaccagcgaccgguggaaggacuaccugcucuacaagcgcuggcagcaccuggagaagaagcugcggcucuaccgcaaccaggacgugaugcuguggcugaugacccucgagcugacgaagaaccacuucaaggagcugaaccucaacuaccaccagcugaagcuggagaaccucgccgugaacguccaggaggccgacgcgaagcugaacccccugaaccagacccucccgauggugcugcccgugaaggucuaccccgccaccgccuucggcgaggugcaguaccacaagacccccauccggaccgucuacauccgcgaggagcacacgaaggcccugaagaugggcaacuucaaggcccucgugaaggaccggcgccugaacgggcuguucagcuucaucaaggaggagaacgacacccagaagcacccgaucucccagcuccggcugcgccgggagcuggagaucuaccagagccuccgcguggacgcguucaaggagacccugucccuggaggagaagcuccugaacaagcacaccagccuguccagccucgagaacgaguuccgggcccugcuggaggaguggaagaaggaguacgccgccuccagcauggucacggacgagcacaucgccuucaucgcguccgugcgcaacgccuucugccacaaccaguaccccuucuacaaggaggcccuccacgcccccaucccccuguucaccguggcgcagccgaccaccgaggagaaggacggccuggggaucgccgaggcccuccugaagguccugcgggaguacugcgagaucgucaagagccagaucuga

SEQ ID NO: 11235 - RNA, 3288 nt, Artificial Sequence
  Cas13b variant__Riemerella anatipestifer__WP_064970887.1__Cas13b
auggagaagccccugccgcccaacguguacacccucaagcacaaguucuucuggggcgccuuccugaacaucgcccgccacaacgcguucaucaccaucugccacaucaacgagcagcuggggcucacgaccccgcccaacgacgacaagaucgccgacgucgugugcggcaccuggaacaacauccugaacaacgaccacgaccugcucaagaagucccagcugaccgagcugauccucaagcacuuccccuuccuggccgccaugugcuaccacccgcccaagaaggaggggaagaagaagggcucccagaaggagcagcagaaggagaaggagaacgaggcccagagccaggcggaggcccugaaccccuccgagcucaucaaggugcugaagacgcuggucaagcagcuccggacccugcgcaacuacuacagccaccacucccacaagaagcccgacgccgagaaggacaucuucaagcaccuguacaaggccuucgacgcgagccuccggauggugaaggaggacuacaaggcccacuucaccgugaaccugacccaggacuucgcccaccugaaccgcaaggggaagaacaagcaggacaaccccgacuucgaccgguaccgcuucgagaaggacggcuucuucacggaguccggccuccuguucuucaccaaccuguuccucgacaagcgggacgccuacuggaugcugaagaaggucagcggguucaaggccucccacaagcagagcgagaagaugaccaccgagguguucugccgcucccggauccugcuccccaagcugcgccuggagagccgguacgaccacaaccagaugcuccuggacaugcuguccgagcucagccgcuaccccaagcugcuguacgagaagcucuccgaggaggacaagaagcgguuccagguggaggcggacggcuuccuggacgagaucgaggaggagcagaacccguucaaggacacgcugauccgccaccaggaccgguuccccuacuucgcccuccgcuaccuggaccugaacgagagcuucaaguccauccgguuccaggucgaccucgggaccuaccacuacugcaucuacgacaagaagaucggcgacgagcaggagaagcgccaccugacccggacccugcucagcuucgggcgccugcaggacuucacggagaucaaccggccccaggaguggaaggcccugaccaaggaccucgacuacaaggagaccuccaagcagcccuucaucagcaagaccacgccgcacuaccacaucaccgacaacaagaucggcuuccgccugggcaccagcaaggagcuguaccccucccuggaggugaaggacggggccaaccgcaucgcccaguaccccuacaacagcgacuucguggcgcacgccuucaucuccguccacgagcuccugccccugauguucuaccagcaccucaccggcaagagcgaggaccugcugaaggagacggugcggcacauccagcgcaucuacaaggacuucgaggaggagcggaucaacaccaucgaggaccucgagaaggccaaccaggggcgccugccgcugggcgccuuccccaagcagaugcucggccugcugcagaacaagcagcccgaccucuccgagaaggccaagaucaagaucgagaagcugaucgcggagaccaagcugcucagccaccggcugaacaccaagcugaaguccagccccaagcucgggaagcgccgggagaagcugaucaagacgggcgugcuggccgacuggcucgucaaggacuucaugcgcuuccagccgguggccuacgacgcccagaaccagcccaucgaguccagcaaggccaacuccaccgaguuccagcugauccagcgggcgcuggcccucuacgggggcgagaagaaccgccuggagggguacuucaagcagaccaaccugaucggcaacaccaacccccaccccuuccucaacaaguucaacuggaaggccugccggaaccugguggacuucuaccagcaguaccuggagcagcgcgagaaguuccucgaggccaucaagaaccagccgugggagcccuaccaguacugccugcugcucaagauccccaaggagaaccggaagaaccuggucaagggcugggagcagggcgggaucagccugccgcgcggccucuucacggaggcgauccgggagacccuguccaaggaccugacccucagcaagcccauccgcaaggagaucaagaagcacgggcgggugggguucaucucccgcgccaucacccuguacuuccgggagaaguaccaggacgaccaccagagcuucuacgaccugcccuacaagcucgaggccaaggccagcccccugccgaagaaggagcacuacgaguacuggcagcagaacaagccccagagccccacggagcugcagcgccucgagcugcacaccuccgaccgcuggaaggacuaccugcucuacaagcgguggcagcaccuggagaagaagcugcgccucuaccggaaccaggacgugaugcuguggcugaugacccucgagcugaccaagaaccacuucaaggagcugaaccucaacuaccaccagcugaagcuggagaaccucgccgucaacgugcaggaggcggacgccaagcugaacccccugaaccagacccucccgauggugcugcccgucaagguguaccccgccacggccuucggcgagguccaguaccaggagacccccauccgcaccguguacauccgggaggagcagaccaaggcccugaagaugggcaacuucaaggcgcucgugaaggaccgccggcugaacgggcuguucagcuucaucaaggaggagaacgacacgcagaagcacccgaucagccagcuccgccugcggcgcgagcuggagaucuaccagucccuccgggucgacgccuucaaggagacccugaaccuggaggagaagcuccugaagaagcacaccagccuguccagcguggagaacaaguuccgcauccuccuggaggaguggaagaaggaguacgccgccuccagcauggugaccgacgagcacaucgccuucaucgcguccguccggaacgccuucugccacaaccaguaccccuucuacgaggaggcccugcacgcccccaucccccucuucacgguggcgcagcagaccaccgaggagaaggacggccuggggaucgccgaggcccugcuccgcgugcugcgggaguacugcgagaucgucaagagccagaucuga

SEQ ID NO: 11236 - RNA, 2853 nt, Artificial Sequence
  Cas13b variant__Riemerella anatipestifer__WP_061710138.1__Cas13b
auguucuucagcuuccacaacgcccagcgcgugaucuucaagcaccuguacaaggccuucgacgcgucccuccggauggugaaggaggacuacaaggcccacuucaccgugaaccugacccgcgacuucgcccaccugaaccggaagggcaagaacaagcaggacaaccccgacuucaaccgcuaccgguucgagaaggacggguucuucacggagagcggccuccuguucuucaccaaccuguuccucgacaagcgcgacgccuacuggaugcugaagaagguguccggguucaaggccagccacaagcaguccgagaagaugaccaccgaggucuucugccggagccgcauccugcucccgaagcugcggcuggagucccgcuacgaccacaaccagaugcuccuggacaugcugagcgagcucucccggugccccaagcugcuguacgagaagcucagcgagaaggacaagaagugcuuccagguggaggcggacggcuuccuggacgagaucgaggaggagcagaaccccuucaaggacacgcugauccgccaccaggaccgguuccccuacuucgcccuccgcuaccuggaccugaacgaguccuucaagagcauccgguuccagguggaccucgggaccuaccacuacugcaucuacgacaagaagaucggcuacgagcaggagaagcgccaccugacccggacccugcucaacuucggccgccugcaggacuucacggagaucaaccggccgcaggaguggaaggcccugaccaaggaccucgacuacaacgagaccuccaaccagcccuucaucagcaagaccacgccccacuaccacaucaccgacaacaagaucggguuccgccugcggaccuccaaggagcuguaccccagccucgaggucaaggacggcgccaaccgcaucgcgaaguacccguacaacuccgacuucguggcccacgccuucaucagcaucuccgugcacgagcugcugccccucauguucuaccagcaccugaccggcaagagcgaggaccugcucaaggagacgguccgccacauccagcggaucuacaaggacuucgaggaggagcgcaucaacaccaucgaggaccuggagaaggccaaccaggggcggcugccccucggggccuuccccaagcagaugcugggccugcuccagaacaagcagccggaccugagcgagaaggcgaagaucaagaucgagaagcugaucgccgagaccaagcuccugucccaccgccugaacaccaagcucaagagcucccccaagcugggcaagcggcgcgagaagcugaucaagacgggggugcuggccgacuggcucgugaaggacuucaugcgguuccagcccgucguguacgacgcccagaaccagcccaucaagagcuccaaggccaacagcaccgagucccgccugauccggcgcgcgcuggcccucuacggcggggagaagaaccggcuggagggcuacuucaagcagaccaaccugaucggcaacaccaacccgcaccccuuccucaacaaguucaacuggaaggccugccgcaaccugguggacuucuaccagcaguaccuggagcagcgggagaaguuccucgaggccaucaagcaccagcccugggagcccuaccaguacugccugcugcucaaggucccgaaggagaaccgcaagaaccuggugaaggggugggagcagggcgggaucagccugccccggggccucuucacggaggccauccgcgagacccuguccaaggaccugacccucagcaagcccauccggaaggagaucaagaagcacgggcgcgugggcuucaucucccgggcgaucacccuguacuucaaggagaaguaccaggacaagcaccagagcuucuacaaccuguccuacaagcucgaggccaaggcgccccugcugaagaaggaggagcacuacgaguacuggcagcagaacaagccgcagagccccacggagucccagcgccucgagcugcacaccagcgaccgcuggaaggacuaccugcucuacaagcgguggcagcaccuggagaagaagcugcgccucuaccggaaccaggacaucaugcuguggcugaugacccucgagcugaccaagaaccacuucaaggagcugaaccucaacuaccaccagcugaagcuggagaaccucgccgucaacgugcaggaggccgacgccaagcugaacccccugaaccagacgcuccccauggugcugccggucaagguguaccccaccaccgccuucggcgaggugcaguaccacgagacccccauccgcacggucuacauccgggaggagcagaccaaggcccugaagauggggaacuucaaggcccucgugaaggaccgccaccugaacggccuguucuccuucaucaaggaggagaacgacacccagaagcacccgaucagccagcuccggcugcgccgggagcuggagaucuaccagucccuccgcgucgacgcguucaaggagacccugagccuggaggagaagcuccugaacaagcacgccagccuguccagccucgagaacgaguuccggacccugcuggaggaguggaagaagaaguacgccgccuccagcauggugacggacaagcacaucgccuucaucgcguccgugcgcaacgccuucugccacaaccaguaccccuucuacaaggagacccuccacgcccccauccugcuguucaccgucgcccagcccaccacggaggagaaggacgggcucggcaucgccgaggcgcugcugcgggugcuccgcgaguacugcgagaucgucaagagccagaucuga

SEQ ID NO: 11237 - RNA, 2850 nt, Artificial Sequence
  ARMAN Cas9 variant__Candidatus Micrarchaeum acidiphilum__OJI07263.1__Cas9
augcgcgacagcaucaccgcgccccgguacuccagcgcccuggccgcccgcaucaaggaguucaacuccgccuucaagcucggcaucgaccuggggaccaagacgggcgggguggcccuggucaaggacaacaaggugcuccuggccaagaccuuccuggacuaccacaagcagacccucgaggagcggcgcauccaccggcgcaaccggcgcagccggcuggcgcgccggaagcgcaucgcccggcugcgcuccuggauccuccggcagaagaucuacggcaagcagcugccggaccccuacaagaucaagaagaugcagcugcccaacggggugcgcaagggcgagaacuggaucgaccucgucgugagcggccgggaccugucccccgaggccuucgugcgcgccaucacccugaucuuccagaagcgggggcagcgcuacgaggaggucgcgaaggagaucgaggagaugagcuacaaggaguucuccacgcacaucaaggcccucaccagcgugaccgaggaggaguucaccgcccuggccgccgagaucgagcggcgccaggacguggucgacacggacaaggaggcggagcgcuacacccagcuguccgagcuccugagcaagguguccgagagcaaguccgagagcaaggaccgggcccagcgcaaggaggaccugggcaagguggucaacgccuucugcuccgcccaccggaucgaggacaaggacaaguggugcaaggagcucaugaagcugcuggaccgcccggugcggcacgcccgcuuccucaacaaggugcugauccggugcaacaucugcgaccgcgcgacccccaagaagucccggcccgacguccgcgagcugcucuacuucgacaccgugcggaacuuccugaaggccgggcgcguggagcagaaccccgacgucaucagcuacuacaagaagaucuacauggacgccgaggugauccgggugaagauccugaacaaggagaagcucacggacgaggacaagaagcagaagcgcaagcuggccagcgagcugaaccgguacaagaacaaggaguacgucaccgacgcccagaagaagaugcaggagcagcucaagacccugcuguucaugaagcucaccggccgcagccgguacugcauggcgcaccugaaggagcgcgccgccgggaaggacguggaggagggccugcacggcgugguccagaagcggcacgaccgcaacaucgcccagcgcaaccacgaccuccgggugaucaaccugaucgagucccuccuguucgaccagaacaagagccuguccgacgccauccgcaagaacgggcugauguacgucacgaucgaggcgccggagcccaagaccaagcacgccaagaagggcgccgccguggugcgggacccccgcaagcucaaggagaagcuguucgacgaccagaacggggucugcaucuacaccggccugcagcucgacaagcuggagaucagcaaguacgagaaggaccacaucuuccccgacucccgggacggcccgagcauccgcgacaaccuggugcugaccacgaaggagaucaacuccgacaagggggaccggacccccugggaguggaugcacgacaaccccgagaaguggaaggcguucgagcgccggguggccgaguucuacaagaagggccgcaucaacgagcggaagcgcgagcuccugcugaacaaggggaccgaguaccccggcgacaacccgaccgagcucgcccgcgggggcgcccgggucaacaacuucaucacggaguucaacgaccggcugaagacccacggcgugcaggagcugcagaccaucuucgagcgcaacaagcccaucgugcaggucgugcgcggggaggagacccagcggcuccggcgccaguggaacgcccugaaccagaacuucaucccccugaaggaccgggcgaugagcuucaaccacgccgaggacgccgccaucgccgcguccaugcccccgaaguucuggcgcgagcagaucuaccgcacggccuggcacuucggccccagcgggaacgagcggcccgacuucgcccucgccgagcuggcgccccaguggaacgacuucuucaugaccaagggcgggccgaucaucgccgugcugggcaagaccaaguacuccuggaagcacagcaucaucgacgacaccaucuacaagcccuucuccaagagcgccuacuacgucggcaucuacaagaagcccaacgccaucacguccaacgccaucaaggugcuccgccccaagcugcugaacggggagcacaccaugagcaagaacgcgaaguacuaccaccagaagaucggcaacgagcgguuccucaugaagucccagaagggcgggagcaucaucaccgugaagccgcacgacgggcccgagaagguccugcagaucucccccaccuacgagugcgccgugcugacgaagcacgacggcaagaucaucgugaaguucaagccgaucaagccccuccgcgacauguacgcccggggcgucaucaaggccauggacaaggagcuggagaccagccugagcuccaugagcaagcacgccaaguacaaggagcuccacacccacgacaucaucuaccugcccgcgaccaagaagcacguggacggguacuucaucaucaccaagcuguccgccaagcacggcaucaaggcccuccccgagagcauggugaaggucaaguacacgcagaucggguccgagaacaacagcgaggugaagcugaccaagccgaagcccgagaucacccuggacuccgaggacaucaccaacaucuacaacuucacgcgcuga

SEQ ID NO: 11238 - RNA, 2904 nt, Artificial Sequence
  ARMAN Cas9 variant__Candidatus Parvarchaeum acidiphilum__APG80630.1__Cas9
augcugggcagcucccgcuaccuccgguacaaccugaccagcuucgaggggaaggagcccuuccugaucaugggcuacuacaaggaguacaacaaggagcucuccagcaaggcccagaaggaguucaacgaccagaucuccgaguucaacagcuacuacaagcuggggaucgaccugggcgacaagaccgggaucgccaucgugaagggcaacaagaucauccucgcgaagacgcugaucgaccugcacucccagaagcucgacaagcgccgggaggcccgccggaaccgccggacccgccugagccggaagaagcgccuggcccggcuccgcuccugggugaugcggcagaaggugggcaaccagcgccugccggaccccuacaagaucaugcacgacaacaaguacuggagcaucuacaacaaguccaacagcgccaacaagaagaacuggaucgaccugcucauccacuccaacagccuguccgccgacgacuucgugcgggggcugaccaucaucuuccgcaagcggggcuaccucgcguucaaguaccugagccgccuguccgacaaggaguucgagaaguacaucgacaaccucaagccgcccaucagcaaguacgaguacgacgaggaccuggaggagcuguccagccgggucgagaacggggagaucgaggagaagaaguucgagggccucaagaacaagcuggacaagaucgacaaggagagcaaggacuuccaggugaagcagcgcgaggaggugaagaaggagcuggaggaccucgucgaccuguucgccaaguccguggacaacaagaucgacaaggcccgguggaagcgcgagcugaacaaccuccuggacaagaaggugcgcaagauccgguucgacaaccgcuucauccugaagugcaagaucaaggggugcaacaagaacacccccaagaaggagaagguccgggacuucgagcucaagauggugcugaacaacgcccgcagcgacuaccagaucuccgacgaggaccugaacagcuuccggaacgaggugaucaacaucuuccagaagaaggagaaccucaagaagggcgagcugaagggcgucacgaucgaggaccugcgcaagcagcucaacaagaccuucaacaaggcgaagaucaagaaggggauccgggagcagauccgcuccaucguguucgagaagaucagcggccgguccaaguucugcaaggagcaccugaaggaguucagcgagaagcccgcccccuccgaccgcaucaacuacggggugaacagcgcccgggagcagcacgacuuccgcguccugaacuucaucgacaagaagaucuucaaggacaagcucaucgaccccuccaagcugcgguacaucaccaucgagagcccggagcccgagaccgagaagcuggagaagggccagaucuccgagaaguccuucgagacgcucaaggagaagcuggccaaggagaccggcgggaucgacaucuacaccggcgagaagcugaagaaggacuucgagaucgagcacaucuucccccgcgcccggauggggcccagcauccgcgagaacgagguggcgagcaaccucgagaccaacaaggagaaggccgaccggacgccgugggagugguucggccaggacgagaagcgcugguccgaguucgagaagcgggugaacagccuguacuccaagaagaagaucagcgagcgcaagcgcgagauccugcugaacaagagcaacgaguaccccgggcucaaccccaccgagcugucccggauccccagcacccuguccgacuucgucgagagcauccgcaagauguucgugaaguacggcuacgaggagccgcagacccucgugcagaagggcaagcccaucauccaggucgugcgggggcgcgacacgcaggcccugcgguggcgcuggcacgcccuggacuccaacaucauccccgagaaggaccgcaagagcuccuucaaccacgccgaggacgcggugaucgccgccugcaugcccccguacuaccuccggcagaagaucuuccgggaggaggccaagaucaagcgcaaggucagcaacaaggagaaggaggugacccggcccgacaugcccaccaagaagaucgcccccaacugguccgaguucaugaagacccgcaacgagccggucaucgaggugaucggcaaggugaagcccagcuggaagaacuccaucauggaccagacguucuacaaguaccugcugaagcccuucaaggacaaccucaucaagauccccaacgucaagaacaccuacaaguggaucggggugaacggccagaccgacagccugucccugccgagcaaggugcucuccaucagcaacaagaaggucgacuccagcaccgugcugcuggugcacgacaagaagggcgggaagcggaacuggguccccaagagcaucggcgggcuccugguguacaucacgcccaaggacggcccgaagcgcaucgugcaggucaagcccgcgacccaggggcugcucaucuaccggaacgaggacggccgcguggacgccgugcgggaguucaucaaccccgucaucgagauguacaacaacgggaagcuggccuucguggagaaggagaacgaggaggagcugcucaaguacuucaaccugcuggagaagggccagaaguucgagcgcauccggcgcuacgacaugaucaccuacaacuccaaguucuacuacgugaccaagaucaacaagaaccaccgggucacgauccaggaggagagcaagaucaaggccgaguccgacaaggucaagagcuccagcggcaaggaguacacccgcaaggagaccgaggagcucucccugcagaagcuggccgagcucaucagcaucuga

SEQ ID NO: 11239 - RNA, 2850 nt, Artificial Sequence
  ARMAN Cas9 variant__Candidatus Micrarchaeum sp.__OJT94500.1__Cas9
augcgcgacagcaucaccgcgccccgguacuccagcgcccuggccgcccgcaucaaggaguucaacuccgccuucaagcucggcaucgaccuggggaccaagacgggcgggguggcccuggucaaggacaacaaggugcuccuggccaagaccuuccuggacuaccacaagcagacccucgaggagcggcgcauccaccggcgcaaccggcgcagccggcuggcgcgccggaagcgcaucgcccggcugcgcuccuggauccuccggcagaagaucuacggcaagcagcugccggaccccuacaagaucaagaagaugcagcugcccaacggggugcgcaagggcgagaacuggaucgaccucgucgugagcggccgggaccugucccccgaggccuucgugcgcgccaucacccugaucuuccagaagcgggggcagcgcuacgaggaggucgcgaaggagaucgaggagaugagcuacaaggaguucuccacgcacaucaaggcccucaccagcgugaccgaggaggaguucaccgcccuggccgccgagaucgagcggcgccaggacguggucgacacggacaaggaggcggagcgcuacacccagcuguccgagcuccugagcaagguguccgagagcaaguccgagagcaaggaccgggcccagcgcaaggaggaccugggcaagguggucaacgccuucugcuccgcccaccggaucgaggacaaggacaaguggugcaaggagcucaugaagcugcuggaccgcccggugcggcacgcccgcuuccucaacaaggugcugauccggugcaacaucugcgaccgcgcgacccccaagaagucccggcccgacguccgcgagcugcucuacuucgacaccgugcggaacuuccugaaggccgggcgcguggagcagaaccccgacgucaucagcuacuacaagaagaucuacauggacgccgaggugauccgggugaagauccugaacaaggagaagcucacggacgaggacaagaagcagaagcgcaagcuggccagcgagcugaaccgguacaagaacaaggaguacgucaccgacgcccagaagaagaugcaggagcagcucaagacccugcuguucaugaagcucaccggccgcagccgguacugcauggcgcaccugaaggagcgcgccgccgggaaggacguggaggagggccugcacggcgugguccagaagcggcacgaccgcaacaucgcccagcgcaaccacgaccuccgggugaucaaccugaucgagucccuccuguucgacccgaacaagagccuguccgacgccauccgcaagaacgggcugauguacgucacgaucgaggcgcccgagcccaagaccaagcacgccaagaagggcgccgccguggugcgggacccccgcaagcucaaggagaagcuguucgacgaccagaacggggucugcaucuacaccggccugcagcucgacaagcuggagaucagcaaguacgagaaggaccacaucuucccggacucccgggacggccccagcauccgcgacaaccuggugcugaccacgaaggagaucaacuccgacaagggggaccggacccccugggaguggaugcacgacaaccccgagaaguggaaggcguucgagcgccggguggccgaguucuacaagaagggccgcaucaacgagcggaagcgcgagcuccugcugaacaaggggaccgaguacccgggcgacaaccccaccgagcucgcccgcgggggcgcccgggucaacaacuucaucacggaguucaacgaccggcugaagacccacggcgugcaggagcugcagaccaucuucgagcgcaacaagcccaucgugcaggucgugcgcggggaggagacccagcggcuccggcgccaguggaacgcccugaaccagaacuucaucccccugaaggaccgggcgaugagcuucaaccacgccgaggacgccgccaucgccgcguccaugccgcccaaguucuggcgcgagcagaucuaccgcacggccuggcacuucggccccagcgggaacgagcggcccgacuucgcccucgccgagcuggccccgcaguggaacgacuucuucaugaccaagggcgggcccaucaucgcggugcugggcaagaccaaguacuccuggaagcacagcaucaucgacgacaccaucuacaagcccuucuccaagagcgccuacuacgucggcaucuacaagaagcccaacgccaucacguccaacgccaucaaggugcuccgcccgaagcugcugaacggggagcacaccaugagcaagaacgcgaaguacuaccaccagaagaucggcaacgagcgguuccucaugaagucccagaagggcgggagcaucaucaccgugaagccccacgacgggcccgagaagguccugcagaucuccccgaccuacgagugcgccgugcugacgaagcacgacggcaagaucaucgugaaguucaagcccaucaagccccuccgcgacauguacgcccggggcgucaucaaggccauggacaaggagcuggagaccagccugagcuccaugagcaagcacgccaaguacaaggagcuccacacccacgacaucaucuaccugcccgcgaccaagaagcacguggacggguacuucaucaucaccaagcuguccgccaagcacggcaucaaggcccucccggagagcauggugaaggucaaguacacgcagaucggguccgagaacaacagcgaggugaagcugaccaagcccaagcccgagaucacccuggacuccgaggacaucaccaacaucuacaacuucacgcgcuga

SEQ ID NO: 11240 - RNA, 2961 nt, Artificial Sequence
  CasX variant__Deltaproteobacteria bacterium__OGP07438.1__CasX
auggagaagcgcaucaacaagauccggaagaagcugagcgccgacaacgccaccaagcccgugucccgcagcggcccgaugaagacccuccugguccgggugaugacggacgaccugaagaagcgccucgagaagcggcgcaagaagcccgaggugaugccccaggucaucuccaacaacgcggccaacaaccugcggaugcugcucgacgacuacaccaagaugaaggaggccauccuccagguguacuggcaggaguucaaggacgaccacguggggcugaugugcaaguucgcccagcccgccagcaagaagaucgaccagaacaagcugaagccggagauggacgagaagggcaaccugaccaccgcgggguucgccugcucccagugcggccagccccuguucgucuacaagcucgagcaggucagcgagaaggggaaggccuacacgaacuacuucggccgcugcaacguggccgagcacgagaagcugauccugcucgcgcagcugaagcccgagaaggacuccgacgaggccgugaccuacagccugggcaaguucgggcagcgggcccucgacuucuacuccauccacgugaccaaggagagcacccaccccgugaagccgcuggcccagaucgccggcaaccgcuacgcguccgggcccgucggcaaggcccugagcgacgccugcauggggacgaucgccuccuuccucagcaaguaccaggacaucaucaucgagcaccagaagguggugaagggcaaccagaagcggcuggagucccugcgcgagcucgccggcaaggagaaccuggaguaccccagcgucacccugcccccgcagccccacaccaaggaggggguggacgcguacaacgaggugaucgcccggguccgcaugugggugaaccucaaccuguggcagaagcugaagcucucccgggacgacgccaagccccugcugcgccucaagggcuuccccagcuucccgguggucgagcggcgcgagaacgagguggacugguggaacaccaucaacgaggugaagaagcugaucgacgccaagcgggacauggggcgcgucuucugguccggcgugacggccgagaagcggaacaccauccuggagggcuacaacuaccuccccaacgagaacgaccacaagaagcgcgaggggagccuggagaaccccaagaagcccgcgaagcgccaguucggcgaccugcuccuguaccuggagaagaaguacgccggggacuggggcaaggucuucgacgaggccugggagcggaucgacaagaagaucgccgggcucaccagccacaucgagcgcgaggaggcccggaacgcggaggacgcccaguccaaggccgugcugaccgacuggcugcgcgccaaggcgagcuucgugcucgagcggcugaaggagauggacgagaaggaguucuacgccugcgagauccagcugcagaagugguacggcgaccuccgcggcaacccguucgccgucgaggccgagaaccgggugguggacaucuccggguucagcaucggcuccgacgggcacagcauccaguaccgcaaccugcuggccuggaaguaccuggagaacggcaagcgggaguucuaccuccugaugaacuacgggaagaagggccgcauccgguucacggacggcaccgacaucaagaaguccgggaaguggcagggccugcucuacgggggcgggaaggcgaaggucaucgaccugaccuucgaccccgacgacgagcagcugaucauccucccccuggccuucggcacccgccagggccgggaguucaucuggaacgaccugcucagccuggagacggggcugaucaagcucgccaacggccgcgugaucgagaagaccaucuacaacaagaagaucgggcgggacgagcccgcccuguucguggcccugaccuucgagcgccgggaggucguggacccguccaacaucaagcccgugaaccucaucggcgucgaccgcggcgagaacauccccgcggugaucgcccugaccgaccccgaggggugcccgcugcccgaguucaaggacagcuccggcgggcccacggacauccuccggaucggcgagggguacaaggagaagcagcgcgccauccaggccgccaaggagguggagcagcgccgggcgggcggcuacagccgcaaguucgccuccaagagccggaaccuggccgacgacaugguccgcaacuccgcccgggaccuguucuaccacgcggugacccacgacgccgugcucgucuucgagaaccugagccgcggguucggccggcaggggaagcgcaccuucaugaccgagcggcaguacacgaagauggaggacuggcugaccgccaagcucgccuacgagggccugaccuccaagaccuaccugagcaagacgcucgcccaguacaccuccaagaccugcagcaacugcggguucaccaucacgaccgcggacuacgacggcaugcuggugcgccugaagaagaccagcgacggcugggccaccacccucaacaacaaggagcugaaggccgaggggcagaucacguacuacaaccgguacaagcgccagaccguggagaaggagcuguccgccgagcucgaccggcugagcgaggaguccggcaacaacgacaucagcaaguggaccaaggggcgccgggacgaggcccuguuccuccugaagaagcgcuucucccaccggccgguccaggagcaguucgugugccuggacugcggccacgaggugcacgcggacgagcaggccgcccucaacaucgcccgcagcuggcuguuccugaacuccaacagcaccgaguucaaguccuacaagagcgggaagcagcccuucgucggcgccuggcaggcguucuacaagcggcgccucaaggagguguggaagcccaacgccuga

SEQ ID NO: 11241 - RNA, 2937 nt, Artificial Sequence
  CasX variant__Planctomycetes bacterium__OHB99618.1__CasX
augcaggagaucaagcgcaucaacaagauccggcgccggcuggugaaggacagcaacaccaagaaggccggcaagaccgggcccaugaagacgcuccugguccgcgugaugaccccggaccugcgggagcgccucgagaaccugcggaagaagcccgagaacaucccccagcccaucuccaacaccagccgcgccaaccugaacaagcuccugaccgacuacacggagaugaagaaggcgauccugcacguguacugggaggaguuccagaaggacccggucggccucaugucccggguggcccagcccgcccccaagaacaucgaccagcgcaagcugauccccgugaaggacgggaacgagcggcugaccagcuccggcuucgccugcagccagugcugccagccgcucuacgucuacaagcuggagcaggucaacgacaaggggaagccccacaccaacuacuucggccgcugcaacguguccgagcacgagcggcugauccuccugagcccccacaagcccgaggccaacgacgagcuggugaccuacucccucggcaaguucgggcagcgcgcgcuggacuucuacagcauccacgugacgcgggaguccaaccacccggugaagccccuggagcagaucggcgggaacagcugcgccuccggccccgucgggaaggcccucagcgacgccugcaugggcgcgguggccuccuuccugaccaaguaccaggacaucauccuggagcaccagaaggugaucaagaagaacgagaagcgccucgccaaccugaaggacaucgccagcgccaacggccuggcguuccccaagaucacccucccgccccagccccacaccaaggaggggaucgaggccuacaacaacgucguggcccagaucgugaucugggucaaccugaaccuguggcagaagcucaagaucggccgggacgaggccaagccccugcagcgccugaagggguucccguccuucccccucguggagcggcaggccaacgagguggacuggugggacauggucugcaacgugaagaagcugaucaacgagaagaaggaggacggcaagguguucuggcagaaccuggcgggcuacaagcgccaggaggcccuccugcccuaccugagcuccgaggaggaccggaagaaggggaagaaguucgcccgcuaccaguucggcgaccuccugcugcaccucgagaagaagcacggggaggacuggggcaaggucuacgacgaggccugggagcgcaucgacaagaagguggaggggcugagcaagcacaucaagcuggaggaggagcggcgcagcgaggacgcccaguccaaggcggcccucacggacuggcugcgggccaaggccagcuucgucaucgagggccugaaggaggccgacaaggacgaguucugccgcugcgagcucaagcugcagaagugguacggcgaccugcgggggaagcccuucgcgaucgaggccgagaacuccauccuggacaucagcggcuucuccaagcaguacaacugcgccuucaucuggcagaaggacggggugaagaagcucaaccuguaccugaucaucaacuacuucaagggcgggaagcuccgcuucaagaagaucaagccggaggccuucgaggcgaaccgguucuacaccgugaucaacaagaaguccggcgagaucguccccauggaggugaacuucaacuucgacgaccccaaccugaucauccugccccucgccuucggcaagcgccaggggcgggaguucaucuggaacgaccugcugagccucgagaccggcagccugaagcuggccaacgggcgcgugaucgagaagacccucuacaaccggcgcacgcggcaggacgagccggcccuguucgucgcccugaccuucgagcgccgggaggugcucgacuccagcaacaucaagcccaugaaccugaucggcaucgaccgcggggagaacauccccgcggugaucgcccugaccgacccggagggcugcccccucucccgguucaaggacagccugggcaaccccacccacauccugcgcaucggggaguccuacaaggagaagcagcggacgauccaggccgccaaggaggucgagcagcgccgcgccggcggguacagccggaaguacgcguccaaggccaagaaccucgccgacgacauggugcgcaacaccgcccgggaccugcuguacuacgccgugacccaggacgcgaugcucaucuucgagaaccugagccgcggcuucggccggcaggggaagcgcaccuucauggccgagcggcaguacacgcgcauggaggacuggcugaccgccaagcucgccuacgagggccugcccuccaagaccuaccugagcaagacccucgcgcaguacacguccaagaccugcagcaacugcggguucaccaucaccagcgccgacuacgaccggguccuggagaagcugaagaagacggccaccggcuggaugaccaccaucaacgggaaggagcucaagguggagggccagaucacguacuacaaccgcuacaagcggcagaacguggucaaggaccuguccguggagcuggaccgccucagcgaggaguccgugaacaacgacaucagcuccuggaccaagggccggagcggggaggcccugucccugcucaagaagcgcuucagccaccggccgguccaggagaaguucgugugccugaacugcggcuucgagacccacgccgacgagcaggcggcccugaacaucgcccgcuccuggcuguuccuccggagccaggaguacaagaaguaccagaccaacaagaccacggggaacaccgacaagcgcgccuucguggagaccuggcaguccuucuaccggaagaagcugaaggaggucuggaagcccgccguguga

SEQ ID NO: 11242 - RNA, 3378 nt, Artificial Sequence
  CasY variant__Candidatus Katanobacteria bacterium__OJI08769.1__CasY
augcgcaagaagcuguucaagggcuacauccuccacaacaagcggcugguguacaccgggaaggccgccauccgcagcaucaaguacccccuggucgcgccgaacaagaccgcccucaacaaccuguccgagaagaucaucuacgacuacgagcaccuguucggcccccucaacguggccagcuacgcccggaacuccaaccgcuacagccugguggacuucuggaucgacucccugcgggccggggucaucuggcagagcaaguccacgagccucaucgaccugaucuccaagcuggagggcagcaagucccccagcgagaagaucuucgagcagaucgacuucgagcucaagaacaagcuggacaaggagcaguucaaggacaucauccugcucaacaccgggauccgcuccagcuccaacgugcggagccugcgcggccgguuccugaagugcuucaaggaggaguuccgcgacaccgaggaggugaucgcgugcgucgacaagugguccaaggaccucaucguggagggcaagagcauccugguguccaagcaguuccuguacugggaggaggaguucgggaucaagaucuucccccacuucaaggacaaccacgaccucccgaagcugaccuucuucgucgagcccagccuggaguucagcccccaccucccccuggccaacugccuggagcggcucaagaaguucgacaucucccgcgagagccugcugggccucgacaacaacuucuccgccuucagcaacuacuucaacgagcuguucaaccugcucucccgcggggagaucaagaagaucgugacggccgugcuggcggucagcaaguccugggagaacgagccggagcuggagaagcggcuccacuuccugagcgagaaggccaagcugcucggcuaccccaagcugaccuccagcugggccgacuaccggaugaucaucgggggcaagaucaaguccuggcacagcaacuacaccgagcagcugaucaaggugcgcgaggaccucaagaagcaccagaucgcccuggacaagcugcaggaggaccucaagaagguggucgacuccagccugcgggagcagaucgaggcccagcgcgaggcgcugcucccccugcuggacaccaugcugaaggagaaggacuucuccgacgaccucgagcuguaccgguucauccugagcgacuucaagucccuccugaacggcagcuaccagcgcuacauccagacggaggaggagcggaaggaggaccgcgacgugaccaagaaguacaaggaccuguacuccaaccuccgcaacaucccccgguucuucggggagagcaagaaggagcaguucaacaaguucaucaacaagagccugccgaccaucgacgugggccugaagauccucgaggacauccgcaacgcccuggagaccgucuccgugcggaagccgcccagcaucacggaggaguacgugaccaagcagcuggagaagcucucccgcaaguacaagaucaacgccuucaacagcaaccgguucaagcagaucaccgagcagguccugcgcaaguacaacaacggggagcugcccaagaucuccgagguguucuaccgguacccccgcgagagccacguggccauccggauccuccccgucaagaucuccaacccccgcaaggacaucagcuaccugcuggacaaguaccagaucucccccgacuggaagaacagcaacccgggcgagguggucgaccucaucgagaucuacaagcugacccugggcuggcuccuguccugcaacaaggacuucagcauggacuucuccagcuacgaccugaagcuguuccccgaggccgcgucccucaucaagaacuucgggagcugccuguccggcuacuaccucagcaagaugaucuucaacugcaucacgagcgagaucaaggggaugaucacccuguacacccgggacaaguucguggugcgcuacgucacccagaugaucggcuccaaccagaaguucccccugcucugccuggugggggagaagcagacgaagaacuucagccggaacuggggcgugcugaucgaggagaagggcgaccucggggaggagaagaaccaggagaagugccugaucuucaaggacaagaccgacuucgccaaggccaaggaggucgagaucuucaagaacaacaucuggcgcauccggaccuccaaguaccagauccaguuccugaaccgccucuucaagaagaccaaggagugggaccugaugaaccuggugcucagcgagcccucccuggugcuggaggaggaguggggcgucagcugggacaaggacaagcuccugccgcugcucaagaaggagaaguccugcgaggagcggcuguacuacagccugccccucaaccuggugcccgccacggacuacaaggagcaguccgccgagaucgagcagcgcaacaccuaccuggggcucgacgugggcgaguucggggucgcguacgccguggugcggaucguccgcgaccgcaucgagcugcugagcuggggcuuccucaaggaccccgcccugcggaagauccgcgagcgggugcaggacaugaagaagaagcaggucauggccguguucuccagcuccagcaccgccguggcgcgcgugcgggagauggccauccacucccugcgcaaccagauccacagcaucgcccucgccuacaaggcgaagaucaucuacgagaucuccaucagcaacuucgagaccggcgggaaccggauggccaagaucuaccgcuccaucaaggucagcgacguguaccgggagagcggcgccgacacgcugguguccgagaugaucugggggaagaagaacaagcagaugggcaaccacaucagcuccuacgccaccagcuacacgugcugcaacugcgcccgcaccccguucgagcuggucaucgacaacgacaaggaguacgagaagggcggggacgaguucaucuucaacgugggcgacgagaagaaggugcggggguuccuccagaagucccugcugggcaagaccaucaaggggaaggagguccucaagagcaucaaggaguacgcgcgcccgcccauccgggaggugcugcuggagggcgaggacguggagcagcuccugaagcgccggggcaacuccuacaucuaccgcugccccuucugcggguacaagaccgacgccgacauccaggccgcccugaacaucgccugccggggcuacaucagcgacaacgcgaaggacgccgucaaggagggggagcgcaagcucgacuacauccuggaggugcggaagcugugggagaagaacggcgccgugcuccgcuccgccaaguuccuguga

SEQ ID NO: 11243 - RNA, 3864 nt, Artificial Sequence
  CasY variant__Candidatus Kerfeldbacteria bacterium__OGY82221.1__CasY
augaagcgcauccugaacagccucaagguggccgcccugcggcuccucuuccgcggcaagggguccgagcuggucaagaccgugaaguacccccuggugagcccgguccagggcgcgguggaggagcucgccgaggccauccggcacgacaaccugcaccuguucgggcagaaggagaucguggaccucauggagaaggacgagggcacccaggucuacuccgugguggacuucuggcuggacacgcugcgccucgggauguucuucagccccuccgccaacgcccugaagaucacccugggcaaguucaacagcgaccaggucucccccuuccggaaggugcucgagcagagccccuucuuccuggcgggccgccugaagguggagccggccgagcggauccucuccgucgagauccgcaagaucgggaagcgggagaaccgcguggagaacuacgccgccgacguggagaccugcuucaucggccagcugagcuccgacgagaagcagagcauccagaagcuggcgaacgacaucugggacuccaaggaccacgaggagcagcggaugcucaaggccgacuucuucgccaucccccugaucaaggaccccaaggccgucaccgaggaggaccccgagaacgagacggccgggaagcagaagccgcuggagcucugcgugugccuggugcccgagcuguacacccgcggcuucgggagcaucgcggacuuccucguccagcggcugacccugcuccgcgacaagauguccaccgacacggccgaggacugccuggaguacgugggcaucgaggaggagaagggcaacgggaugaacagccugcucggcaccuuccugaagaaccugcagggggacggcuucgagcagaucuuccaguucaugcucggcuccuacgugggguggcagggcaaggaggacguccugcgggagcgccuggaccuccuggccgagaaggugaagcggcugcccaagcccaaguucgccggggaguggagcggccaccgcauguuccuccacgggcagcugaaguccuggagcagcaacuucuuccggcuguucaacgagacccgcgagcuccuggaguccaucaagagcgacauccagcacgccaccaugcugaucuccuacguggaggagaagggcggcuaccacccgcagcuccugagccaguaccggaagcugauggagcagcugcccgcgcuccgcacgaagguccuggaccccgagaucgagaugacccacauguccgaggccgugcgcagcuacaucaugauccacaaguccgucgccggguuccugcccgaccuccuggagagccuggaccgggacaaggaccgcgaguuccuccuguccaucuucccgcggauccccaagaucgacaagaagaccaaggagaucguggccugggagcugcccggcgagcccgaggagggguaccucuucaccgccaacaaccuguuccgcaacuuccuggagaacccgaagcacgugccccgguucauggcggagcgcauccccgaggacuggacgcggcuccgcagcgcccccgucugguucgacggcauggugaagcaguggcagaagguggucaaccagcugguggaguccccgggggcccuguaccaguucaacgagagcuuccuccggcagcgccugcaggccaugcugaccguguacaagcgggaccuccagaccgagaaguuccugaagcugcucgccgacgucugccgcccccugguggacuucuucggccugggcgggaacgacaucaucuucaaguccugccaggacccccggaagcaguggcagaccgugaucccccucagcgucccggcggacguguacacggccugcgagggccuggccauccgccugcgggagacccucggguucgaguggaagaaccugaagggccacgagcgcgaggacuuccugcggcuccaccagcugcuggggaaccuccuguucuggauccgcgacgccaagcugguggucaagcucgaggacuggaugaacaaccccugcgugcaggaguacguggaggcgcggaaggccaucgaccugccccuggagaucuucggcuucgaggucccgaucuuccucaacggcuaccuguucuccgagcugcgccagcucgagcugcugcuccgccgcaagagcgugaugaccuccuacagcgugaagaccacggggucccccaaccggcuguuccagcuggucuaccucccccugaaccccagcgacccggagaagaagaacagcaacaacuuccaggagcggcuggacacccccaccggccucucccgccgguuccuggaccugacccucgacgccuucgccgggaagcugcugacggaccccgugacccaggagcucaagaccauggccggcuucuacgaccaccuguucggcuucaagcugcccugcaagcucgcggccaugagcaaccacccgggguccagcuccaagauggugguccuggccaagcccaagaagggcguggccagcaacaucggguucgagcccauccccgacccggcccaccccguguuccgcguccgguccagcuggcccgagcugaaguaccucgagggccugcuguaccuccccgaggacaccccgcugacgaucgagcuggcggagaccuccgugagcugccaguccgugagcuccgucgccuucgaccucaagaaccugaccaccauccuggggcgcgugggcgaguuccgggugacggccgaccagcccuucaagcucacccccaucauccccgagaaggaggagagcuucaucggcaagaccuaccuggggcuggacgccggcgagcgcuccggggucggcuucgccaucgugaccguggacggggacggcuacgagguccagcggcucggcgugcacgaggacacccagcugauggcgcugcagcaggucgccagcaagucccucaaggagccgguguuccagccccugcgcaaggggacguuccggcagcaggagcgcauccgcaagagccugcggggcugcuacuggaacuucuaccacgcccucaugaucaaguaccgggccaagguggugcacgaggagagcgucggguccagcggccugguggggcaguggcugcgcgcguuccagaaggaccucaagaaggccgacgugcugcccaagaagggcggcaagaacggggucgacaagaagaagcgggaguccagcgcccaggacacccuguggggcggggccuucuccaagaaggaggagcagcagaucgccuucgaggugcaggcggccggcagcucccaguucugccucaagugcggguggugguuccagcugggcaugcgcgaggugaaccggguccaggagagcggcguggugcuggacuggaaccgcuccaucgucaccuuccucaucgagagcuccggggagaagguguacggcuucagcccccagcagcuggagaagggguuccgcccggacaucgagaccuucaagaagaugguccgggacuucaugcgcccgcccauguucgaccggaagggccgccccgccgccgccuacgagcgguucgugcugggccgccggcaccgccgguaccgcuucgacaagguguucgaggagcgguucgggcgcuccgcgcuguucaucugcccccgggucggcugcgggaacuucgaccacagcuccgagcagagcgccguggugcuggcccugaucggcuacaucgccgacaaggaggggauguccggcaagaagcuggucuacgugcgccucgccgagcugauggcggaguggaagcugaagaagcucgagcggagccgcguggaggagcaguccagcgcccaguga

SEQ ID NO: 11244 - RNA, 3579 nt, Artificial Sequence
  CasY variant__Candidatus Komeilibacteria bacterium__OJI06454.1__CasY
auggccgagagcaagcagaugcagugccgcaagugcggcgccuccaugaaguacgaggugaucgggcugggcaagaaguccugccgguacaugugccccgacugcgggaaccacaccagcgcgcgcaagauccagaacaagaagaagcgggacaagaaguacggcagcgccuccaaggcccagagccagcgcaucgccgucgccggggcgcucuacccggacaagaaggugcagaccaucaagacguacaaguaccccgccgaccugaacggcgaggugcacgaccggggcgucgccgagaagaucgagcaggccauccaggaggacgagaucgggcugcucggccccuccagcgaguacgcgugcuggaucgccucccagaagcagagcgagcccuacuccgugguggacuucugguucgacgccgucugcgccgggggcguguucgccuacagcggggcgcgccugcuguccaccgugcuccagcugagcggcgaggaguccguccugcgggccgcccucgccagcuccccguucguggacgacaucaaccuggcccaggcggagaaguuccuggccgugagccgccggaccggccaggacaagcucgggaagcgcaucggcgagugcuucgccgaggggcggcuggaggcccugggcaucaaggaccgcaugcgggaguucguccaggccaucgacguggcgcagaccgccggccagcgcuucgccgccaagcucaagaucuucgggaucucccagaugcccgaggccaagcaguggaacaacgacagcggccugacggugugcauccugcccgacuacuacguccccgaggagaaccgggcggaccagcucguggugcugcugcgccggcuccgcgagaucgccuacugcauggggaucgaggacgaggccggcuucgagcaccuggggaucgacccgggcgcccugagcaacuucuccaacggcaaccccaagcggggguuccucggccgccugcugaacaacgacaucaucgcgcucgccaacaacaugagcgccaugacccccuacugggaggggcggaagggcgagcugaucgagcgccuggccuggcucaagcaccgcgccgaggggcuguaccugaaggagccccacuucggcaacuccugggcggaccaccggagccgcaucuucucccggaucgccggcuggcucagcgggugcgccggcaagcugaagaucgccaaggaccagaucuccgggguccgcaccgaccuguuccuccugaagcggcugcucgacgccgugccgcagagcgcgcccucccccgacuucaucgccagcaucuccgcccuggaccgcuuccuggaggccgccgagagcucccaggaccccgcggagcagguccgggcccucuacgccuuccaccugaacgccccggcggugcgcagcaucgccaacaaggccgugcagcgguccgacagccaggaguggcugaucaaggagcucgacgccguggaccaccuggaguucaacaaggccuuccccuucuucuccgacaccggcaagaagaagaagaagggggcgaacagcaacggcgcccccuccgaggaggaguacacggagaccgagagcauccagcagcccgaggacgccgagcaggaggucaacggccaggaggggaacggcgccagcaagaaccagaagaaguuccagcgcaucccgcgguucuucggggagggcucccgcagcgaguaccggauccugaccgaggcgccccaguacuucgacauguucugcaacaacaugcgcgccaucuucaugcagcucgagucccagccccggaaggcgccccgcgacuucaagugcuuccugcagaaccggcugcagaagcuguacaagcagaccuuccucaacgcccgcagcaacaagugccgggcccugcuggaguccgugcucaucagcuggggcgaguucuacacguacggggccaacgagaagaaguuccgccugcgccacgaggccuccgagcggagcuccgacccggacuacgucgugcagcaggcccuggagaucgcccgccggcuguuccuguucggcuucgaguggcgcgacugcagcgccggggagcggguggaccuggucgagauccacaagaaggcgaucuccuuccuccuggccaucacccaggccgaggugagcgugggcuccuacaacuggcuggggaacagcaccgucucccgcuaccucagcguggccggcaccgacacgcuguacggcacccagcuggaggaguuccucaacgccaccgugcugucccagaugcgggggcuggcgauccgccucagcagccaggagcugaaggacggcuucgacguccagcuggaguccagcugccaggacaaccuccagcaccuccugguguaccgggccucccgcgaccucgccgccugcaagcgggccacgugccccgcggagcuggaccccaagauccuggugcuccccgccggggccuucaucgccagcgucaugaagaugaucgagcgcggcgacgagccgcuggccggggcguaccugcggcaccgcccccacuccuucggcuggcagauccgggugcgcggcguggccgaggucgggauggaccagggcacggcccucgccuuccagaagcccaccgagagcgagccguucaagaucaagcccuucuccgcccaguacgggcccgugcuguggcugaacagcuccagcuacucccagagccaguaccucgacggcuuccugucccagcccaagaacuggagcaugcgggugcugccgcaggcgggguccguccgcguggagcagcggguggcccucaucuggaaccugcaggccggcaagaugcgccuggagcggagcggcgcccgcgcguucuucaugcccguccccuucuccuuccgccccagcggguccggcgacgaggccgugcucgccccgaaccgguaccuggggcuguucccccacagcggcgggaucgaguacgccguggucgacgugcucgacagcgccggcuucaagauccuggagcgcggcaccaucgcggugaacggguucucccagaagcggggcgagcgccaggaggaggcccaccgggagaagcagcgccgggggaucagcgacaucggccgcaagaagcccguccaggccgagguggacgccgccaacgagcugcaccggaaguacaccgacguggcgacgcgccucggcugccggaucgucgugcagugggcgccccagccgaagcccgggaccgcccccaccgcccagaccguguacgcccgcgccguccggacggaggcgccccgcuccggcaaccaggaggaccacgcccggaugaaguccagcuggggguacaccuggagcaccuacugggagaagcgcaagccggaggacauccugggcaucuccacccagguguacuggaccgggggcaucggcgagagcugccccgccguggccgucgcccugcucgggcacauccgggccaccuccacccagaccgagugggagaaggaggaggugguguucggccgccugaagaaguucuuccccagcuga

SEQ ID NO: 11245 - RNA, 3633 nt, Artificial Sequence
  CasY variant__Candidatus Parcubacteria bacterium__APG80656.1__CasY
augagcaagcgccacccccggaucuccggcgugaagggguaccgccugcacgcccagcggcucgaguacaccggcaagagcggggccaugcgcaccaucaaguacccgcuguacuccagccccuccggcgggcggacggucccccgcgagaucgugagcgcgaucaacgacgacuacgugggccuguacggccucuccaacuucgacgaccuguacaacgccgagaagcggaacgaggagaaggucuacagcgugcuggacuucugguacgacugcgugcaguacggggccgucuucuccuacaccgcccccggccuccugaagaacguggccgaggugcgcgggggcagcuacgagcugaccaagacccucaaggggucccaccuguacgacgagcugcagaucgacaaggucaucaaguuccucaacaagaaggagaucagccgggcgaacggcucccuggacaagcugaagaaggacaucaucgacugcuucaaggccgaguaccgcgagcggcacaaggaccagugcaacaagcucgccgacgacaucaagaacgccaagaaggacgcgggcgccagccugggggagcgccagaagaagcuguuccgggacuucuucggcaucuccgagcagagcgagaacgacaagccguccuucacgaacccccucaaccugaccugcugccugcuccccuucgacaccgugaacaacaaccgcaaccgcggggaggugcuguucaacaagcugaaggaguacgcccagaagcucgacaagaacgagggcagccuggagaugugggaguacaucggcaucgggaacuccggcaccgccuucagcaacuuccugggggagggcuuccucgggcggcugcgggagaacaagaucacggagcugaagaaggccaugauggacaucaccgacgcguggcgcggccaggagcaggaggaggagcucgagaagcggcugcgcauccuggccgcccucaccaucaagcugcgggagcccaaguucgacaaccacuggggcggguaccgcagcgacaucaacggcaagcuguccagcuggcuccagaacuacaucaaccagaccgucaagaucaaggaggaccugaaggggcacaagaaggaccugaagaaggccaaggagaugaucaaccgcuucggcgaguccgacacgaaggaggaggccguggugagcucccuccuggagagcaucgagaagaucgucccggacgacuccgcggacgacgagaagcccgacauccccgccaucgccaucuaccggcgcuuccugagcgacgggcggcucacccugaaccgcuucgugcagcgggaggacgugcaggaggcccugaucaaggagcgccucgaggccgagaagaagaagaagcccaagaagcggaagaagaaguccgacgcggaggacgagaaggagaccaucgacuucaaggagcuguucccgcaccuggccaagccccucaagcugguccccaacuucuacggcgacagcaagcgcgagcuguacaagaaguacaagaacgccgccaucuacaccgacgcccuguggaaggcgguggagaagaucuacaaguccgccuucagcuccagccucaagaacuccuucuucgacacggacuucgacaaggacuucuucaucaagcggcugcagaagaucuucagcguguaccgccgguucaacaccgacaaguggaagcccaucgucaagaacuccuucgccccguacugcgacaucgugagccuggccgagaacgaggugcucuacaagcccaagcagucccgcagccgcaagagcgcggccaucgacaagaaccggguccggcugcccuccaccgagaacaucgccaaggccggcaucgcccuggcgcgcgagcucagcguggccggguucgacuggaaggaccugcugaagaaggaggagcacgaggaguacaucgaccucaucgagcugcacaagaccgcccuggcccuccugcuggccgucacggagacccagcucgacaucuccgcgcuggacuucguggagaacggcaccgugaaggacuucaugaagacccgggacgggaaccugguccucgagggccgcuuccuggagauguucagccaguccaucguguucagcgagcugcgggggcucgccggccugaugucccgcaaggaguucaucacgcgcagcgccauccagaccaugaacggcaagcaggccgagcugcucuacaucccccacgaguuccaguccgccaagaucaccaccccgaaggagaugagccgggcguuccuggaccuggcccccgccgaguucgccacgucccucgagcccgagagccuguccgagaagucccugcucaagcugaagcagaugcgcuacuacccccacuacuucggguacgagcugacccggaccggccaggggaucgacggcggcguggcggagaacgcccuccgccuggagaaguccccggucaagaagcgggagaucaagugcaagcaguacaagacccuggggcgcggccagaacaagaucgugcucuacgugcggagcagcuacuaccagacgcaguuccuggagugguuccugcaccgccccaagaacguccagaccgacguggccgugagcgggagcuuccucaucgacgagaagaaggucaagacccgguggaacuacgacgcccugaccguggcccuggagcccguguccggcagcgagcgcgucuucgugucccagcccuucacgaucuucccggagaaguccgcggaggaggaggggcagcgguaccucggcaucgacaucggcgaguacgggaucgccuacaccgcccuggagaucaccggcgacagcgccaagauccuggaccagaacuucaucagcgacccccagcucaagacccugcgcgaggaggugaaggggcugaagcucgaccagcggcgcggcaccuucgccaugcccuccacgaagaucgcgcggauccgcgagagccugguccacucccugcggaaccgcauccaccaccucgcccugaagcacaaggccaagaucguguacgagcuggaggugagccgguucgaggaggggaagcagaagaucaagaaggucuacgccacccucaagaaggccgacguguacuccgagaucgacgcggacaagaaccugcagaccaccguguggggcaagcuggccgucgccagcgagaucuccgccagcuacacgucccaguucugcggcgcgugcaagaagcucuggcgcgccgagaugcaggucgacgagaccaucaccacccaggagcugaucgggacggugcgggugaucaagggcgggacccugaucgacgccaucaaggacuucaugcgcccgcccaucuucgacgagaacgacacccccuuccccaaguaccgcgacuucugcgacaagcaccacaucagcaagaagaugcggggcaacuccugccucuucaucugcccguucugccgcgccaacgccgacgcggacauccaggccagccagaccaucgcccugcugcgguacgugaaggaggagaagaagguggaggacuacuucgagcgcuuccggaagcucaagaacaucaagguccuggggcagaugaagaagaucuga

SEQ ID NO: 11246 - RNA, 3681 nt, Artificial Sequence
  CasY variant__Candidatus Vogelbacteria bacterium__OJI07455.1__CasY
augcagaaggugcgcaagacccugagcgagguccacaagaaccccuacggcaccaaggugcggaacgccaagacgggguacucccuccagaucgagcgccugagcuacaccggcaaggaggggaugcgguccuucaagaucccgcuggagaacaagaacaaggagguguucgacgaguucgucaagaagauccgcaacgacuacaucagccaggugggccuccugaaccuguccgacugguacgagcacuaccaggagaagcaggagcacuacagccucgccgacuucuggcuggacucccugcgggcgggggugaucuucgcccacaaggagaccgagaucaagaaccucaucagcaagauccgcggcgacaaguccaucgucgacaaguucaacgccagcaucaagaagaagcacgccgaccuguacgcccugguggacaucaaggcgcucuacgacuuccugaccuccgacgcccggcgcggccugaagacggaggaggaguucuucaacagcaagcggaacacccucuuccccaaguuccgcaagaaggacaacaaggccguggaccugugggucaagaaguucaucgggcuggacaacaaggacaagcucaacuucaccaagaaguucaucggcuucgaccccaacccccagaucaaguacgaccacaccuucuucuuccaccaggacaucaacuucgaccuggagcggaucacgaccccgaaggagcugaucuccaccuacaagaaguuccucgggaagaacaaggaccuguacggcagcgacgagaccacggaggaccagcugaagauggugcucggguuccacaacaaccacggcgccuucuccaaguacuucaacgcgagccuggaggccuuccgcggccgggacaacucccugguggagcagaucaucaacaacagccccuacuggaacucccaccgcaaggagcucgagaagcggaucaucuuccugcagguccagagcaagaagaucaaggagaccgagcuggggaagccccacgaguaccucgccagcuucggcgggaaguucgaguccugggugagcaacuaccugcgccaggaggaggaggugaagcggcagcuguucggcuacgaggagaacaagaagggccagaagaaguucaucgucgggaacaagcaggagcucgacaagaucauccgcggcaccgacgaguacgagaucaaggccaucuccaaggagaccaucgggcugacgcagaagugccugaagcuccuggagcagcugaaggacagcguggacgacuacacccucucccuguaccggcagcugaucguggagcuccgcauccggcugaacgucgaguuccaggagaccuaccccgagcugaucggcaagagcgagaaggacaaggagaaggacgccaagaacaagcgcgcggacaagcgcuacccgcagaucuucaaggacaucaagcucauccccaacuuccugggggagaccaagcagaugguguacaagaaguucauccgguccgccgacauccuguacgagggcaucaacuucaucgaccagaucgacaagcagaucacgcagaaccuccugcccugcuucaagaacgacaaggagcgcaucgaguucaccgagaagcaguucgagacccugcggcgcaaguacuaccugaugaacagcucccgguuccaccacgugaucgagggcaucaucaacaaccgcaagcucaucgagaugaagaagcgggagaacagcgagcugaagaccuucuccgacagcaaguucguccuguccaagcuguuccugaagaaggggaagaaguacgagaacgagguguacuacacguucuacaucaaccccaaggcccgcgaccagcggcgcaucaagaucgugcuggacaucaacggcaacaacagcgucgggauccuccaggaccuggugcagaagcugaagccgaagugggacgacaucaucaagaagaacgacaugggcgagcucaucgacgccaucgagaucgagaagguccggcuggggauccugaucgcccucuacugcgagcacaaguucaagaucaagaaggagcugcugucccucgaccuguucgcgagcgccuaccaguaccuggagcucgaggacgaccccgaggagcuguccggcaccaaccugggccgcuuccuccagagccuggugugcuccgagaucaagggggccaucaacaagaucagccggaccgaguacaucgagcgcuacaccgugcagcccaugaacacggagaagaacuacccccugcucaucaacaaggagggcaaggccaccuggcacaucgccgcgaaggacgaccugagcaagaagaagggcggcgggaccgucgccaugaaccagaagaucgggaagaacuucuucggcaagcaggacuacaagaccguguucaugcugcaggacaagcgguucgaccuccugacguccaaguaccaccuccaguuccucagcaagacccuggacaccgggggcggguccugguggaagaacaagaacaucgaccugaaccucagcuccuacagcuucaucuucgagcagaaggugaaggucgagugggaccugaccaaccuggaccacccgaucaagaucaagcccuccgagaacagcgacgaccgccgccucuucguguccauccccuucgugaucaagcccaagcagacgaagcggaaggaccugcagacccgggucaacuacaugggcaucgacaucggcgaguacgggcuggccuggaccaucaucaacaucgaccucaagaacaagaagaucaacaagaucagcaagcagggcuucaucuacgagccgcugacccacaaggugcgcgacuacguggccaccaucaaggacaaccagguccgcgggacguucggcaugcccgacaccaagcuggcccggcuccgcgagaacgcgaucaccucccugcggaaccaggugcacgacaucgccaugcgcuacgacgccaagcccguguacgaguucgagaucagcaacuucgagaccggguccaacaaggucaaggugaucuacgacagcgugaagcgggccgacaucggccgcggccagaacaacacggaggcggacaacaccgaggucaaccuggugugggggaagaccuccaagcaguucggcagccagaucggggccuacgccaccuccuacaucugcagcuucugcggcuacagccccuacuacgaguucgagaacuccaagagcggggacgaggagggcgcccgggacaaccucuaccagaugaagaagcugucccgcccgagccuggaggacuuccuccagggcaaccccguguacaagacguuccgggacuucgacaaguacaagaacgaccagcgccugcagaagaccggggacaaggacggcgaguggaagacccaccgggggaacaccgccaucuacgcgugccagaagugccgccacaucuccgacgccgacauccaggccagcuacuggaucgcccugaagcaggucgugcgggacuucuacaaggacaaggagauggacggcgaccucauccagggggacaacaaggacaagcgcaaggugaacgagcugaaccggcugaucggcguccacaaggacgugcccaucaucaacaagaaccucaucacgucccuggacaucaaccugcucuga

SEQ ID NO: 11247 - RNA, 3603 nt, Artificial Sequence
  CasY variant__Candidatus Vogelbacteria bacterium__OJI09436.1__CasY
augaaggccaagaaguccuucuacaaccagaagcgcaaguucggcaagcggggguaccgccugcacgacgagcggaucgccuacagcggcgggaucggcagcaugcgcuccaucaaguacgagcucaaggacagcuacgggaucgcgggccugcggaaccgcaucgccgacgccaccaucuccgacaacaaguggcuguacggcaacaucaaccucaacgacuaccuggaguggcggagcuccaagaccgacaagcagaucgaggacggggaccgcgagagcucccugcucggcuucuggcuggaggcccugcggcucggguucguguucagcaagcagucccacgcccccaacgacuucaacgagacggcgcugcaggaccuguucgagacccucgacgacgaccugaagcacguccuggaccgcaagaaguggugcgacuucaucaagaucggcaccccgaagaccaacgaccaggggcggcucaagaagcagaucaagaaccugcugaagggcaacaagcgcgaggagaucgagaagacgcucaacgagagcgacgacgagcugaaggagaagaucaaccggaucgccgacguguucgccaagaacaaguccgacaaguacaccaucuucaagcuggacaagcccaacaccgagaaguacccccgcaucaacgacgugcaggucgccuucuucugccaccccgacuucgaggagaucaccgagcgggaccgcacgaagacccucgaccugaucaucaaccgguucaacaagcgcuacgagaucaccgagaacaagaaggacgacaagaccagcaaccggauggcgcuguacucccucaaccagggcuacaucccgcgcgugcugaacgaccuguuccucuucgugaaggacaacgaggacgacuucagccaguuccuguccgaccuggagaacuucuucagcuucuccaacgagcagaucaagaucaucaaggagcggcucaagaagcugaagaaguacgccgagcccauccccgggaagccccagcuggccgacaagugggacgacuacgccagcgacuucggcgggaagcucgagagcugguacuccaaccgcaucgagaagcugaagaagaucccggagagcgucuccgaccugcgcaacaaccucgagaagauccggaacgugcugaagaagcagaacaacgccagcaagauccuggagcucucccagaagaucaucgaguacauccgcgacuacggcgugagcuucgagaagcccgagaucaucaaguucuccuggaucaacaagacgaaggacggccagaagaaggucuucuacguggcgaagauggccgaccgggaguucaucgagaagcuggaccuguggauggccgaccuccgcagccagcugaacgaguacaaccaggacaacaagguguccuucaagaagaaggggaagaagaucgaggagcugggcguccucgacuucgcccugaacaaggccaagaagaacaagagcaccaagaacgagaacggguggcagcagaagcuguccgagagcauccaguccgcgccccucuucuucggcgaggggaaccgggugcgcaacgaggagguguacaaccugaaggaccugcuguucagcgagaucaagaacgucgagaacauccucauguccagcgaggccgaggaccugaagaacaucaagaucgaguacaaggaggacggcgccaagaagggcaacuacgugcugaacgugcucgcccgguucuacgcccgcuucaacgaggacggguacggcggguggaacaaggucaagaccgugcuggagaacaucgcgcgggaggccggcaccgacuucuccaaguacgggaacaacaacaaccgcaacgccggccgguucuaccugaacggccgcgagcgccagguguucacgcucaucaaguucgagaaguccaucaccgucgagaagauccuggagcuggugaagcuccccagccugcuggacgaggccuaccgggaccucgugaacgagaacaagaaccacaagcugcgggacgucauccagcugagcaagaccaucauggcccucgugcugagccacuccgacaaggagaagcagaucgggggcaacuacauccacagcaagcuguccggguacaacgcgcucaucagcaagcgcgacuucaucucccgguacagcguccagaccacgaacggcacccagugcaagcuggccaucgggaagggcaaguccaagaagggcaacgagaucgaccgcuacuucuacgccuuccaguucuucaagaacgacgacagcaagaucaaccugaaggugaucaagaacaacucccacaagaacaucgacuucaacgacaacgagaacaagaucaacgcccuccagguguacagcuccaacuaccagauccaguuccuggacugguucuucgagaagcaccaggggaagaagaccagccuggaggucggcggguccuucaccaucgcggagaagucccucacgaucgacuggagcggcagcaacccgcgggugggcuucaagcgcuccgacaccgaggagaagcgcguguucgucagccagcccuucacccugauccccgacgacgaggacaaggagcggcgcaaggagcggaugaucaagaccaagaaccgcuucaucgggaucgacaucggcgaguacgggcuggccuggagccucaucgagguggacaacggcgacaagaacaaccgggggauccgccagcuggaguccggcuucaucacggacaaccagcagcagguccugaagaagaacgucaagagcuggcggcagaaccagauccgccagaccuucaccucccccgacaccaagaucgcccggcuccgcgagagccugaucggcuccuacaagaaccagcuggagagccucaugguggccaagaaggccaaccuguccuucgaguacgaggugagcggguucgaggugggcgggaagcggguggcgaagaucuacgacuccaucaagcgcggcagcgugcggaagaaggacaacaacucccagaacgaccagagcugggggaagaagggcaucaacgagugguccuucgagacgaccgccgccggcaccagccaguucugcacccacugcaagcgcugguccagccuggccaucgucgacaucgaggaguacgagcucaaggacuacaacgacaaccuguucaaggugaagaucaacgacggggaggugcggcugcucggcaagaagggguggcgcuccggcgagaagaucaaggggaaggagcuguucggcccggucaaggacgccaugcggcccaacguggacggccuggggaugaagaucgugaagcgcaaguaccucaagcuggaccugcgggacugggucagccgcuacggcaacauggcgaucuucaucugccccuacguggacugccaccacaucucccacgccgacaagcaggccgccuucaacaucgccgugcggggguaccucaagagcgucaaccccgaccgcgcgaucaagcacggcgacaaggggcugagccgcgacuuccugugccaggaggagggcaagcucaacuucgagcagaucggccugcuguga

SEQ ID NO: 11248 - RNA, 3462 nt, Artificial Sequence
  CasY variant__Candidatus Vogelbacteria bacterium__PIP58309.1__CasY
augcagaaggugcgcaagacccugagcgagguccacaagaaccccuacggcaccaaggugcggaacgccaagacgggguacucccuccagaucgagcgccugagcuacaccggcaaggaggggaugcgguccuucaagaucccgcuggagaacaagaacaaggagguguucgacgaguucgucaagaagauccgcaacgacuacaucagccaggugggccuccugaaccuguccgacugguacgagcacuaccaggagaagcaggagcacuacagccucgccgacuucuggcuggacucccugcgggcgggggugaucuucgcccacaaggagaccgagaucaagaaccucaucagcaagauccgcggcgacaaguccaucgucgacaaguucaacgccagcaucaagaagaagcacgccgaccuguacgcccugguggacaucaaggcgcucuacgacuuccugaccuccgacgcccggcgcggccugaagacggaggaggaguucuucaacagcaagcggaacacccucuuccccaaguuccgcaagaaggacaacaaggccguggaccugugggucaagaaguucaucgggcuggacaacaaggacaagcucaacuucaccaagaaguucaucggcuucgaccccaacccccagaucaaguacgaccacaccuucuucuuccaccaggacaucaacuucgaccuggagcggaucacgaccccgaaggagcugaucuccaccuacaagaaguuccucgggaagaacaaggaccuguacggcagcgacgagaccacggaggaccagcugaagauggugcucggguuccacaacaaccacggcgccuucuccaaguacuucaacgcgagccuggaggccuuccgcggccgggacaacucccugguggagcagaucaucaacaacagccccuacuggaacucccaccgcaaggagcucgagaagcggaucaucuuccugcagguccagagcaagaagaucaaggagaccgagcuggggaagccccacgaguaccucgccagcuucggcgggaaguucgaguccugggugagcaacuaccugcgccaggaggaggaggugaagcggcagcuguucggcuacgaggagaacaagaagggccagaagaaguucaucgucgggaacaagcaggagcucgacaagaucauccgcggcaccgacgaguacgagaucaaggccaucuccaaggagaccaucgggcugacgcagaagugccugaagcuccuggagcagcugaaggacagcguggacgacuacacccucucccuguaccggcagcugaucguggagcuccgcauccggcugaacgucgaguuccaggagaccuaccccgagcugaucggcaagagcgagaaggacaaggagaaggacgccaagaacaagcgcgcggacaagcgcuacccgcagaucuucaaggacaucaagcucauccccaacuuccugggggagaccaagcagaugguguacaagaaguucauccgguccgccgacauccuguacgagggcaucaacuucaucgaccagaucgacaagcagaucacgcagaaccuccugcccugcuucaagaacgacaaggagcgcaucgaguucaccgagaagcaguucgagacccugcggcgcaaguacuaccugaugaacagcucccgguuccaccacgugaucgagggcaucaucaacaaccgcaagcucaucgagaugaagaagcgggagaacagcgagcugaagaccuucuccgacagcaaguucguccuguccaagcuguuccugaagaaggggaagaaguacgagaacgagguguacuacacguucuacaucaaccccaaggcccgcgaccagcggcgcaucaagaucgugcuggacaucaacggcaacaacagcgucgggauccuccaggaccuggugcagaagcugaagccgaagugggacgacaucaucaagaagaacgacaugggcgagcucaucgacgccaucgagaucgagaagguccggcuggggauccugaucgcccucuacugcgagcacaaguucaagaucaagaaggagcugcugucccucgaccuguucgcgagcgccuaccaguaccuggagcucgaggacgaccccgaggagcuguccggcaccaaccugggccgcuuccuccagagccuggugugcuccgagaucaagggggccaucaacaagaucagccggaccgaguacaucgagcgcuacaccgugcagcccaugaacacggagaagaacuacccccugcucaucaacaaggagggcaaggccaccuggcacaucgccgcgaaggacgaccugagcaagaagaagggcggcgggaccgucgccaugaaccagaagaucgggaagaacuucuucggcaagcaggacuacaagaccguguucaugcugcaggacaagcgguucgaccuccugacguccaaguaccaccuccaguuccucagcaagacccuggacaccgggggcggguccugguggaagaacaagaacaucgaccugaaccucagcuccuacagcuucaucuucgagcagaaggugaaggucgagugggaccugaccaaccuggaccacccgaucaagaucaagcccuccgagaacagcgacgaccgccgccucuucguguccauccccuucgugaucaagcccaagcagacgaagcggaaggaccugcagacccgggucaacuacaugggcaucgacaucggcgaguacgggcuggccuggaccaucaucaacaucgaccucaagaacaagaagaucaacaagaucagcaagcagggcuucaucuacgagccgcugacccacaaggugcgcgacuacguggccaccaucaaggacaaccagguccgcgggacguucggcaugcccgacaccaagcuggcccggcuccgcgagaacgcgaucaccucccugcggaaccaggugcacgacaucgccaugcgcuacgacgccaagcccguguacgaguucgagaucagcaacuucgagaccggguccaacaaggucaaggugaucuacgacagcgugaagcgggccgacaucggccgcggccagaacaacacggaggcggacaacaccgaggucaaccuggugugggggaagaccuccaagcaguucggcagccagaucggggccuacgccaccuccuacaucugcagcuucugcggcuacagccccuacuacgaguucgagaacuccaagagcggggacgaggagggcgcccgggacaaccucuaccagaugaagaagcugucccgcccgagccuggaggacuuccuccagggcaaccccguguacaagacguuccgggacuucgacaaguacaagaacgaccagcgccugcagaagaccggggacaaggacggcgaguggaagacccaccgggggaacaccgccaucuacgcgugccagaagugcuga

SEQ ID NO: 11249 - RNA, 3480 nt, Artificial Sequence
  Cas13a variant__Leptotrichia buccalis__WP_015770004.1__Cas13a
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgagaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaagaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgauagaaaguugaaaaacgccgugaugaaguccguagucgacauccugaaagaauauggcuucguggcuacauucaagauuggggccgauaagaaaaucggaauacagacuuuagagucagaaaagauuguucaccucaaaaaucugaagaaaaagaaacuuaugaccgacaggaacagcgaggagcugugcaaguuggugaagaucauguuugaauacaaaauggaggaaaagaaaucugagaacuga

SEQ ID NO: 11250 - RNA, 3480 nt, Artificial Sequence
  Cas13a variant__Leptotrichia buccalis__WP_015770004.1__Cas13a(R472A,H477A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauugcacauggaauaguggccuucaaucuggagcucgaagguaaggauaucuuugcuuucaaaaacauugccccaucagagaucaguaagaaaauguuucagaaugaaauuaacgagaagaagcugaaacuuaagaucuuccggcaacugaauagcgcaaacguuuuucgauacuuggagaaauauaagauacucaauuaccugaaacgcacgagauucgaauuugugaacaagaauaucccguucguccccuccuuuacuaaauuauauucuaggauugacgaccugaagaacagccuaggcaucuacuggaagaccccuaaaacaaaugaugacaacaagacuaaagagauuaucgaugcucagauauaccuccugaagaauauuuauuacggggaguuccuuaacuauuucaugucaaacaauggaaacuuuuucgagaucaguaaagagauuaucgaauugaauaagaacgacaagcggaaucugaaaaccggcuuuuacaagcuccagaaauucgaggauauacaggaaaagaucccaaaagaguaucuggccaacauucaaucccuuuacaugaucaaugcggguaaccaggacgaagaggagaaggauacauauauugacuuuauccagaagauauuccugaaaggguuuaugaccuacuuggccaauaacggacgccucagccugauuuacaucggcucugaugaagagacgaauacuucauuagcagaaaagaaacaagaguucgacaaguuucugaaaaaguaugaacagaacaauaacaucaagauucccuacgagaucaaugaguuccuaagagaaauuaaacucggcaacauacugaaguauacagagaggcuuaauauguuuuacuugauccugaaacuccugaaccacaaggaauuaaccaaccugaaagggagucuugagaaguaucagagcgcuaauaaggaagaggccuucuccgaucaguuggagcucauuaaccugcuaaaucuggacaacaaucgugugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaucgggccuuuuauaauaucaagaaauacgggauguugaaccuguuagagaagauugcagacaaagccggauacaagaucucuauugaagaacucaaaaaguauucgaauaagaaaaacgaaaucgagaagaaucacaaaaugcaagagaaccugcaccgaaaguacgcuagaccuaggaaagaugaaaaguucaccgacgaggauuaugaaagcuacaagcaggcgauagagaacauugaagaguauacgcaucuuaaaaauaagguugaguuuaacgaacugaauuugcuccagggccugcuacugcgcauccuccaccggcugguggguuacaccuccaucugggagagagaccuuagguuccgcuugaaaggggaauuuccagagaaccaguauauugaagagauauucaauuuugagaacaagaaaaaugucaaguacaagggcggacaaaucguggaaaaauacauuaaguucuauaaagagcugcaucagaacgaugaagucaagaucaauaaauacucaagugcaaacauuaagguguuaaaacaggagaagaaggaccucuauauccgaaauuacauagcccacuuuaacuauaucccccacgcugagauuucucugcuugaaguucuggagaaucuacggaaacuccugagcuacgaucguaaguugaaaaacgccgugaugaaguccguagucgacauccugaaagaauauggcuucguggcaacauucaagauuggggccgauaagaaaaucggaauacagacuuuagagucagaaaagauuguucaucucaaaaaucugaagaaaaagaaacuuaugaccgacagaaacagcgaggagcugugcaaguuggugaagaucauguuugaauacaaaauggaggaaaagaaaucugagaacuga

SEQ ID NO: 11251 - RNA, 3480 nt, Artificial Sequence
  Cas13a variant__Leptotrichia buccalis__WP_015770004.1__Cas13a(R1048A,H1053A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgagaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaagaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauaucgcgaauuacauagcagccuuuaacuauaucccccacgcugagauuucucugcuugaaguucuggagaaucuacggaaacuccugagcuacgaucguaaguugaaaaacgccgugaugaaguccguagucgacauccugaaagaauauggcuucguggcaacauucaagauuggggccgauaagaaaaucggaauacagacuuuagagucagaaaagauuguucaucucaaaaaucugaagaaaaagaaacuuaugaccgacagaaacagcgaggagcugugcaaguuggugaagaucauguuugaauacaaaauggaggaaaagaaaucugagaacuga

SEQ ID NO: 11252 - RNA, 3480 nt, Artificial Sequence
  Cas13a variant__Leptotrichia buccalis__WP_015770004.1__Cas13a(R472A,H477A,R1048A,H1053A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauugcacauggaauaguggccuucaaucuggagcucgaagguaaggauaucuuugcuuucaaaaacauugccccaucagagaucaguaagaaaauguuucagaaugaaauuaacgagaagaagcugaaacuuaagaucuuccggcaacugaauagcgcaaacguuuuucgauacuuggagaaauauaagauacucaauuaccugaaacgcacgagauucgaauuugugaacaagaauaucccguucguccccuccuuuacuaaauuauauucuaggauugacgaccugaagaacagccuaggcaucuacuggaagaccccuaaaacaaaugaugacaacaagacuaaagagauuaucgaugcucagauauaccuccugaagaauauuuauuacggggaguuccuuaacuauuucaugucaaacaauggaaacuuuuucgagaucaguaaagagauuaucgaauugaauaagaacgacaagcggaaucugaaaaccggcuuuuacaagcuccagaaauucgaggauauacaggaaaagaucccaaaagaguaucuggccaacauucaaucccuuuacaugaucaaugcggguaaccaggacgaagaggagaaggauacauauauugacuuuauccagaagauauuccugaaaggguuuaugaccuacuuggccaauaacggacgccucagccugauuuacaucggcucugaugaagagacgaauacuucauuagcagaaaagaaacaagaguucgacaaguuucugaaaaaguaugaacagaacaauaacaucaagauucccuacgagaucaaugaguuccuaagagaaauuaaacucggcaacauacugaaguauacagagaggcuuaauauguuuuacuugauccugaaacuccugaaccacaaggaauuaaccaaccugaaagggagucuugagaaguaucagagcgcuaauaaggaagaggccuucuccgaucaguuggagcucauuaaccugcuaaaucuggacaacaaucgugugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaucgggccuuuuauaauaucaagaaauacgggauguugaaccuguuagagaagauugcagacaaagccggauacaagaucucuauugaagaacucaaaaaguauucgaauaagaaaaacgaaaucgagaagaaucacaaaaugcaagagaaccugcaccgaaaguacgcuagaccuaggaaagaugaaaaguucaccgacgaggauuaugaaagcuacaagcaggcgauagagaacauugaagaguauacgcaucuuaaaaauaagguugaguuuaacgaacugaauuugcuccagggccugcuacugcgcauccuccaccggcugguggguuacaccuccaucugggagagagaccuuagguuccgcuugaaaggggaauuuccagagaaccaguauauugaagagauauucaauuuugagaacaagaaaaaugucaaguacaagggcggacaaaucguggaaaaauacauuaaguucuauaaagagcugcaucagaacgaugaagucaagaucaauaaauacucaagugcaaacauuaagguguuaaaacaggagaagaaggaccucuauaucgccaauuacauagcugccuuuaacuauaucccccacgcagagauuucucugcuugaaguucuggagaaucuacgaaaacuccugagcuacgaucggaaguugaaaaacgccgugaugaaguccguagucgacauccugaaagaauauggcuucguggcuacauucaagauuggggccgauaagaaaaucggaauacagacuuuagagucagaaaagauuguucaccucaaaaaucugaagaaaaagaaacuuaugaccgaccguaacagcgaggagcugugcaaguuggugaagaucauguuugaauacaaaauggaggaaaagaaaucugagaacuga

SEQ ID NO: 11253 - RNA, 3480 nt, Artificial Sequence
  Cas13a variant__Leptotrichia buccalis__WP_015770004.1__Cas13a(R1079A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgagaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaagaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgaugccaaguugaaaaacgcugugaugaaguccguagucgacauccugaaagaauauggcuucguggccacauucaagauuggggcagauaagaaaaucggaauacagacuuuagagucagaaaagauuguucaccucaaaaaucugaagaaaaagaaacuuaugaccgacagaaacagcgaggagcugugcaaguuggugaagaucauguuugaauacaaaauggaggaaaagaaaucugagaacuga

SEQ ID NO: 11254 - RNA, 3480 nt, Artificial Sequence
  Cas13a variant__Leptotrichia buccalis__WP_015770004.1__Cas13a(E299A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgcuaugucucagcugcuuaagaauuauguguacaaacgccuguccaacauuucaaaugauaagaucaagcgaauauuugaguaucaaaacuugaaaaagcucauugagaacaaacuguuaaauaagcuggacacauacgugagaaacuguggcaaauauaauuacuaucuccaggauggugaaaucgcaaccagcgacuucaucgccaggaaccggcagaaugaggcuuuucuucguaacauuaucggggucaguucuguugccuacuucucccugcgcaauauuuuggaaacugagaacgaaaaugauauaacaggaagaaugaggggcaagaccgugaagaacaauaaaggcgaggagaaguacguaagcggggaaguggacaaaaucuauaacgagaauaagaaaaacgaagucaaggagaaucuaaagauguucuacucguaugauuuuaacauggacaacaaaaaugaaauugaggauuucuuugcgaacaucgacgaggcaaucucuuccauucggcauggaauagugcacuucaaucuggaacucgaggguaaggauaucuuugccuucaaaaacauugcuccaucagaaaucaguaagaaaauguuucagaaugagauuaacgaaaagaagcugaaacuuaagaucuuccgacaacugaauagcgccaacguuuuucgcuacuuggagaaauauaagauacucaauuaccugaaaagaacgagguucgaguuugugaacaagaauaucccguucguccccuccuuuacuaaauuauauucucggauugacgaccugaagaacagccuaggcaucuacuggaagaccccuaaaacaaaugaugacaacaagacuaaagaaauuaucgaugcacagauauaccuccugaagaauauuuauuacggggaguuccuuaacuauuucaugucaaacaauggaaacuuuuucgaaaucaguaaagagauuaucgaguugaauaagaacgacaagcgcaaucugaaaaccggcuuuuacaagcuccagaaauucgaagauauacaggagaagaucccaaaagaauaucuggcuaacauucaaucccuuuacaugaucaaugccgguaaccaggacgaggaagagaaggauacauauauugacuuuauccagaagauauuccugaaaggguuuaugaccuacuuggcgaauaacggaagacucagccugauuuacaucggcucugaugaggaaacgaauacuucauuagccgagaagaaacaagaguucgacaaguuucugaaaaaguaugaacagaacaauaacaucaagauucccuacgaaaucaaugaguuccuaagggagauuaaacucggcaacauacugaaguauacagaacgucuuaauauguuuuacuugauccugaaacuccugaaccauaaggaguuaaccaaccugaaagggagucuugaaaaguaucagagcgcaaauaaggaggaggcuuucuccgaucaguuggaacucauuaaccugcuaaaucuggacaacaaucgggugacugaggauuuugaacucgaggccgacgaaaucggaaaauuccuggacuucaacgguaauaagguaaaagauaacaaggagcuuaaaaaguuugacacaaauaaaauuuacuucgauggcgagaacaucauaaagcaccgagcuuuuuauaauaucaagaaauacgggauguugaaccuguuagaaaagauugccgacaaagcaggauacaagaucucuauugaggaacucaaaaaguauucgaauaagaaaaacgagaucgaaaagaaucacaaaaugcaagagaaccugcauagaaaguacgccaggccucgcaaagaugagaaguucaccgacgaagauuaugagagcuacaagcaggcuauagaaaacauugaggaauauacgcaccuuaaaaauaagguugaguuuaacgagcugaauuugcuccagggccugcuacugcggauccuccauagacugguggguuacaccuccaucugggaaagggaccuucgcuuccgauugaaaggggaguuuccagaaaaccaguauauugaggaaauauucaauuuugagaacaagaaaaaugucaaguacaagggcggacaaaucguggagaaauacauuaaguucuauaaagaacugcaccagaacgaugaggucaagaucaauaaauacucaagugcgaacauuaagguguuaaaacaggaaaagaaggaccucuauauccggaauuacauagcacacuuuaacuauaucccccaugccgagauuucucugcuugagguucuggaaaaucuacguaaacuccugagcuacgauagaaaguugaaaaacgcugugaugaaguccguagucgacauccugaaagaguauggcuucguggccacauucaagauuggggcagauaagaaaaucggaauacagacuuuagaaucagagaagauuguucaccucaaaaaucugaagaaaaagaaacuuaugaccgacaggaacagcgaggaacugugcaaguuggugaagaucauguuugaguacaaaauggaagagaagaaaucugaaaacuga

SEQ ID NO: 11255 - RNA, 3480 nt, Artificial Sequence
  Cas13a variant__Leptotrichia buccalis__WP_015770004.1__Cas13a(K310A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaagaagauauugccaaacucguguuagagaucgaaaaucugaccaaacuugagaaguauaaaauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaggaacucaaugacaagaacauaaaauacgccuuuugccacuucgucgaaaucgagaugucucagcugcuuaagaauuauguguacgcucgccuguccaacauuucaaaugauaaaaucaagcgaauauuugaguaucaaaacuugaagaaacucauugaaaacaagcuguuaaauaaacuggacacauacgugagaaacuguggcaaguauaauuacuaucuccaggauggugagaucgcaaccagcgacuucaucgccaggaaccggcagaaugaggcuuuucuucguaacauuaucggggucaguucuguugccuacuucucccugcgcaauauuuuggaaacugaaaacgagaaugauauaacaggaagaaugaggggcaaaaccgugaagaacaauaagggcgaggaaaaauacguaagcggggagguggacaagaucuauaacgaaaauaaaaagaacgaggucaaagaaaaucuaaagauguucuacucguaugauuuuaacauggacaacaagaaugagauugaggauuucuuugcgaacaucgacgaagcaaucucuuccauucggcauggaauagugcacuucaaucuggagcucgaagguaaagauaucuuugccuucaagaacauugcuccaucagagaucaguaaaaagauguuucagaaugaaauuaacgagaaaaagcugaaacuuaaaaucuuccgacaacugaauagcgccaacguuuuucgcuacuuggagaaguauaaaauacucaauuaccugaagagaacgagguucgaauuugugaacaaaaauaucccguucguccccuccuuuacuaaguuauauucucggauugacgaccugaaaaacagccuaggcaucuacuggaagaccccuaagacaaaugaugacaacaaaacuaaggagauuaucgaugcacagauauaccuccugaaaaauauuuauuacggggaguuccuuaacuauuucaugucaaacaauggaaacuuuuucgaaaucaguaaggagauuaucgaauugaauaaaaacgacaagcgcaaucugaagaccggcuuuuacaaacuccagaaguucgaggauauacaggagaaaaucccaaaggaauaucuggcuaacauucaaucccuuuacaugaucaaugccgguaaccaggacgaagaggagaaagauacauauauugacuuuauccagaagauauuccugaagggguuuaugaccuacuuggcgaauaacggaagacucagccugauuuacaucggcucugaugaagagacgaauacuucauuagccgaaaagaagcaagaguucgacaaauuucugaagaaauaugaacagaacaauaacaucaagauucccuacgagaucaaugaguuccuaagggaaauuaagcucggcaacauacugaaauauacagagcgucuuaauauguuuuacuugauccugaagcuccugaaccauaaagaauuaaccaaccugaaggggagucuugagaaauaucagagcgcaaauaaggaagaggcuuucuccgaucaguuggagcucauuaaccugcuaaaucuggacaacaaucgggugacugaagauuuugagcucgaagccgacgagaucggaaaguuccuggacuucaacgguaauaaaguaaaggauaacaaagagcuuaagaaauuugacacaaauaagauuuacuucgauggcgaaaacaucauaaaacaccgagcuuuuuauaauaucaagaaguacgggauguugaaccuguuagagaaaauugccgacaaggcaggauacaaaaucucuauugaggaacucaagaaauauucgaauaagaagaacgaaaucgagaaaaaucacaagaugcaagagaaccugcauagaaaauacgccaggccucgcaaggaugaaaaauucaccgacgaggauuaugaaagcuacaagcaggcuauagagaacauugaagaguauacgcaccuuaagaauaaaguugaguuuaacgaacugaauuugcuccagggccugcuacugcggauccuccauagacugguggguuacaccuccaucugggagagggaccuucgcuuccgauugaagggggaauuuccagagaaccaguauauugaagagauauucaauuuugagaacaaaaagaaugucaaauacaagggcggacaaaucguggaaaaguacauuaaauucuauaaggagcugcaccagaacgaugaagucaaaaucaauaaguacucaagugcgaacauuaaaguguuaaagcaggagaaaaaggaccucuauauccggaauuacauagcacacuuuaacuauaucccccaugccgagauuucucugcuugaaguucuggagaaucuacguaagcuccugagcuacgauagaaaauugaagaacgcugugaugaaauccguagucgacauccugaaggaauauggcuucguggccacauucaaaauuggggcagauaagaagaucggaauacagacuuuagagucagaaaagauuguucaccucaagaaucugaaaaagaaaaagcugaugaccgacaggaacagcgaggagcuuugcaaguuggugaaaaucauguuugaauacaagauggaggagaaaaagucugaaaacuga

SEQ ID NO: 11256 - RNA, 3480 nt, Artificial Sequence
  Cas13a variant__Leptotrichia buccalis__WP_015770004.1__Cas13a(N314A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaagaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaggaacucaaugacaagaacauaaaauacgccuuuugccacuucgucgaaaucgagaugucucagcugcuuaagaauuauguguacaaacgccuguccgcuauuucaaacgauaagaucaagcgaauauuugaguaucaaaauuugaaaaagcucauugaaaacaaacuguuaaacaagcuggacacauacgugagaaauuguggcaaauauaacuacuaucuccaggauggugagaucgcaaccagcgacuucaucgccaggaaucggcagaacgaggcuuuucuucguaauauuaucggggucaguucuguugccuacuucucccugcgcaacauuuuggaaacugaaaaugagaacgauauaacaggaagaaugaggggcaagaccgugaagaauaacaaaggcgaggaaaaguacguaagcggggagguggacaaaaucuauaaugaaaacaagaaaaaugaggucaaggaaaaccuaaagauguucuacucguaugauuuuaauauggacaacaaaaacgagauugaggauuucuuugcgaauaucgacgaagcaaucucuuccauucggcauggaauagugcacuucaaccuggagcucgaagguaaggauaucuuugccuucaaaaauauugcuccaucagagaucaguaagaaaauguuucagaacgaaauuaaugagaagaagcugaaacuuaagaucuuccgacaacugaacagcgccaauguuuuucgcuacuuggagaaauauaagauacucaacuaccugaaaagaacgagguucgaauuugugaauaagaacaucccguucguccccuccuuuacuaaauuauauucucggauugacgaccugaagaauagccuaggcaucuacuggaagaccccuaaaacaaacgaugacaauaagacuaaagagauuaucgaugcacagauauaccuccugaagaacauuuauuacggggaauuucuuaauuauuucaugucaaacaacggaaauuucuucgagaucaguaaagagauuaucgaauugaacaagaaugacaagcgcaaccugaaaaccggcuuuuacaagcuccagaaauucgaggauauacaggaaaagaucccaaaagaguaucuggcuaauauucaaucccuuuacaugaucaacgccgguaaucaggacgaagaggagaaggauacauauauugacuuuauccagaagauauuccugaaaggguuuaugaccuacuuggcgaacaauggaagacucagccugauuuacaucggcucugaugaagagacgaacacuucauuagccgaaaagaaacaagaguucgacaaguuucugaaaaaguaugaacagaauaacaauaucaagauucccuacgagaucaacgaguuccuaagggaaauuaaacucggcaauauacugaaguauacagagcgucuuaacauguuuuacuugauccugaaacuccugaaucauaaggaauuaaccaaccugaaagggagucuugagaaguaucagagcgcaaacaaggaagaggcuuucuccgaucaguuggagcucauuaaucugcuaaaccuggacaauaaccgggugacugaagauuuugagcucgaagccgacgagaucggaaaauuccuggacuucaaugguaacaagguaaaagauaauaaggagcuuaaaaaguuugacacaaacaaaauuuacuucgauggcgaaaauaucauaaagcaccgagcuuuuuauaacaucaagaaauacgggauguugaaucuguuagagaagauugccgacaaagcaggauacaagaucucuauugaggaacucaaaaaguauucgaacaagaaaaaugaaaucgagaagaaccacaaaaugcaagagaaucugcauagaaaguacgccaggccucgcaaagaugaaaaguucaccgacgaggauuaugaaagcuacaagcaggcuauagagaacauugaagaguauacgcaccuuaaaaacaagguugaguuuaaugaacugaacuugcuccagggccugcuacugcggauccuccauagacugguggguuacaccuccaucugggagagggaccuucgcuuccgauugaaaggggaauuuccagagaaucaguauauugaagagauauucaacuuugagaauaagaaaaacgucaaguacaagggcggacaaaucguggaaaaauacauuaaguucuauaaagagcugcaccagaaugaugaagucaagaucaacaaauacucaagugcgaauauuaagguguuaaaacaggagaagaaggaccucuauauccggaacuacauagcacacuuuaauuauaucccccaugccgagauuucucugcuugaaguucuggagaaccuacguaaacuccugagcuacgauagaaaguugaaaaaugcugugaugaaguccguagucgacauccugaaagaauauggcuucguggccacauucaagauuggggcagauaagaaaaucggaauacagacuuuagagucagaaaagauuguucaccucaaaaaccugaagaaaaagaaacuuaugaccgacaggaauagcgaggagcugugcaaguuggugaagaucauguuugaauacaaaauggaggaaaagaaaucugagaacuga

SEQ ID NO: 11257 - RNA, 3480 nt, Artificial Sequence
  Cas13a variant__Leptotrichia buccalis__WP_015770004.1__Cas13a(R1072A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgagaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaagaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuagccaaacuccugagcuacgaucguaaguugaaaaacgcugugaugaaguccguagucgacauccugaaagaauauggcuucguggccacauucaagauuggggcagauaagaaaaucggaauacagacuuuagagucagaaaagauuguucaccucaaaaaucugaagaaaaagaaacuuaugaccgacagaaacagcgaggagcugugcaaguuggugaagaucauguuugaauacaaaauggaggaaaagaaaucugagaacuga

SEQ ID NO: 11258 - RNA, 3480 nt, Artificial Sequence
  Cas13a variant__Leptotrichia buccalis__WP_015770004.1__Cas13a(D1078A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugagggaaagagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaagauaagggaguucuaccaugaaauuaucgggcggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgagaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaagaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgccagaaaguugaaaaacgcugugaugaaguccguagucgauauccugaaagaauauggcuucguggccacauucaagauuggggcagacaagaaaaucggaauacagacuuuagagucagaaaagauuguucaccucaaaaaucugaagaaaaagaaacuuaugaccgauaggaacagcgaggagcugugcaaguuggugaagaucauguuugaauacaaaauggaggaaaagaaaucugagaacuga

SEQ ID NO: 11259 - RNA, 3480 nt, Artificial Sequence
  Cas13a variant__Leptotrichia buccalis__WP_015770004.1__Cas13a(R1079A,K1080A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugaggggaaaagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaaaauaagggaguucuaccaugaaauuaucggacggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgaaaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaggaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgaugccgcuuugaagaacgccgugaugaaauccguagucgacauccugaaggaauauggcuucguggcaacauucaaaauuggggccgauaagaagaucggaauacagacuuuagagucagaaaagauuguucaccucaagaaucugaaaaagaaaaagcugaugaccgacagaaacagcgaggagcuuugcaaguuggugaaaaucauguuugaauacaagauggaggaaaagaagucugagaacuga
